United States Patent
Brown et al.

(10) Patent No.: US 9,850,486 B2
(45) Date of Patent: Dec. 26, 2017

(54) METHODS AND COMPOSITIONS FOR THE SPECIFIC INHIBITION OF CKAP5 BY DOUBLE-STRANDED RNA

(71) Applicant: Dicerna Pharmaceuticals, Inc., Cambridge, MA (US)

(72) Inventors: Bob D. Brown, Littleton, MA (US); Henryk T. Dudek, Wellesley, MA (US)

(73) Assignee: DICERNA PHARMACEUTICALS, INC., Cambridge, MA (US)

( * ) Notice: Subject to any disclaimer, the term of this patent is extended or adjusted under 35 U.S.C. 154(b) by 0 days.

(21) Appl. No.: 14/651,087

(22) PCT Filed: Dec. 13, 2013

(86) PCT No.: PCT/US2013/074880
§ 371 (c)(1),
(2) Date: Jun. 10, 2015

(87) PCT Pub. No.: WO2014/093746
PCT Pub. Date: Jun. 19, 2014

(65) Prior Publication Data
US 2015/0315583 A1 Nov. 5, 2015

Related U.S. Application Data

(60) Provisional application No. 61/737,404, filed on Dec. 14, 2012.

(51) Int. Cl.
*C12N 15/113* (2010.01)

(52) U.S. Cl.
CPC ........ *C12N 15/113* (2013.01); *C12N 2310/14* (2013.01); *C12N 2310/321* (2013.01)

(58) Field of Classification Search
CPC ... C12N 15/113; A61K 48/7088; A61K 48/00
See application file for complete search history.

(56) References Cited

U.S. PATENT DOCUMENTS

| | | |
|---|---|---|
| 2005/0244858 A1 | 11/2005 | Rossi et al. |
| 2005/0255487 A1 * | 11/2005 | Khvorova ............ A61K 31/713 435/6.11 |
| 2005/0277610 A1 | 12/2005 | Rossi et al. |
| 2006/0223099 A1 | 10/2006 | Matzuk et al. |
| 2007/0265220 A1 | 11/2007 | Rossi et al. |
| 2008/0113351 A1 | 5/2008 | Naito et al. |

FOREIGN PATENT DOCUMENTS

| | | |
|---|---|---|
| CN | 101848923 A | 9/2010 |
| WO | 2005116204 A1 | 12/2005 |
| WO | 2008136902 A1 | 11/2008 |
| WO | 2011-041582 A2 | 4/2011 |
| WO | 2012006241 A2 | 1/2012 |
| WO | 2012018754 A2 | 2/2012 |

OTHER PUBLICATIONS

Cassimeris et al., TOGp, the human homolog of XMAP215/Dis1, is required; for centrosome integrity, spindle pole organization, and bipolar spindle assembly. Mol Biol Cell. Apr. 2004;15(4):1580-90.
Conte et al., TACC1-chTOG-Aurora A protein complex in breast cancer. Oncogene. Nov. 6, 2003;22(50):8102-16.
Florian et al., Modulated microtubule dynamics enable Hklp2/Kif15 to; assemble bipolar spindles. Cell Cycle. Oct. 15, 2011;10(20):3533-44.
Francone et al., The microtubule-associated protein tumor overexpressed gene/cytoskeleton-associated protein 5 is necessary for myelin basic protein expression in oligodendrocytes. J Neurosci. Jul. 18, 2007;27(29):7654-62.
GenBank Accession No. FW872004.1 (Apr. 18, 2011).
GenBank Accession No. GB114464.1 (Jun. 22, 2011).
GenBank Accession No. GB114545.1 (Jun. 22, 2011).
Gergely et al., The ch-TOG/XMAP215 protein is essential for spindle pole organization in human somatic cells. Genes Dev. Feb. 1, 2003;17(3):336-41.
Holmfeldt et al., Differential functional interplay of TOGp/XMAP215 and the Kin1 kinesin MCAK during interphase and mitosis. EMBO J. Feb. 11, 2004;23(3):627-37.
Tiedemann et al., "Identification of molecular vulnerabilities in human multiple myeloma cells by RNA interference lethality screening of the druggable genome". Cancer Research, vol. 72, No. 3, pp. 757-768 (2012).
NCBI, Reference Sequence No. XM_003412252.1 (Aug. 25, 2011).
International Search Report for corresponding International Application No. PCT/US2013/074880, dated Aug. 28, 2014, 6 pages.
Taiwanese Office Action dated Jun. 6, 2017 for Taiwan Patent Application No. 102146027, 12 pages (including English translation).
Barr et al., MCAK-independent functions of ch-Tog/XMAP215 in microtubule plus-end dynamics. Mol Cell Biol. Dec. 2008;28(23):7199-211.
Charrasse et al., Characterization of the cDNA and pattern of expression of a new gene over-expressed in human hepatomas and colonic tumors. Eur J Biochem. Dec. 1, 1995;234(2):406-13.
Lauffart et al., Interaction of the transforming acidic coiled-coil 1 (TACC1) protein with ch-TOG and GAS41/NuBl1 suggests multiple TACC1-containing protein complexes in human cells. Biochem J. Apr. 1, 2002;363(Pt 1):195-200.
Nagase et al., Prediction of the coding sequences of unidentified human genes. III. The coding sequences of 40 new genes (KIAA0081-KIAA0120) deduced by analysis of cDNA clones from human cell line KG-1. DNA Res. 1995;2(1):37-43.
GenBank Accession No. X92474 (Sep. 24, 2008).
Office Action dated Oct. 24, 2017 for Japanese Patent Application No. 2015-547968, 8 pages (including English translation).

* cited by examiner

Primary Examiner — J. E. Angell
(74) Attorney, Agent, or Firm — MH2 Technology Law Group, LLP

(57) ABSTRACT

This invention relates to compounds, compositions, and methods useful for reducing CKAP5 target RNA and protein levels via use of dsRNAs, e.g., Dicer substrate siRNA (DsiRNA) agents.

55 Claims, 79 Drawing Sheets

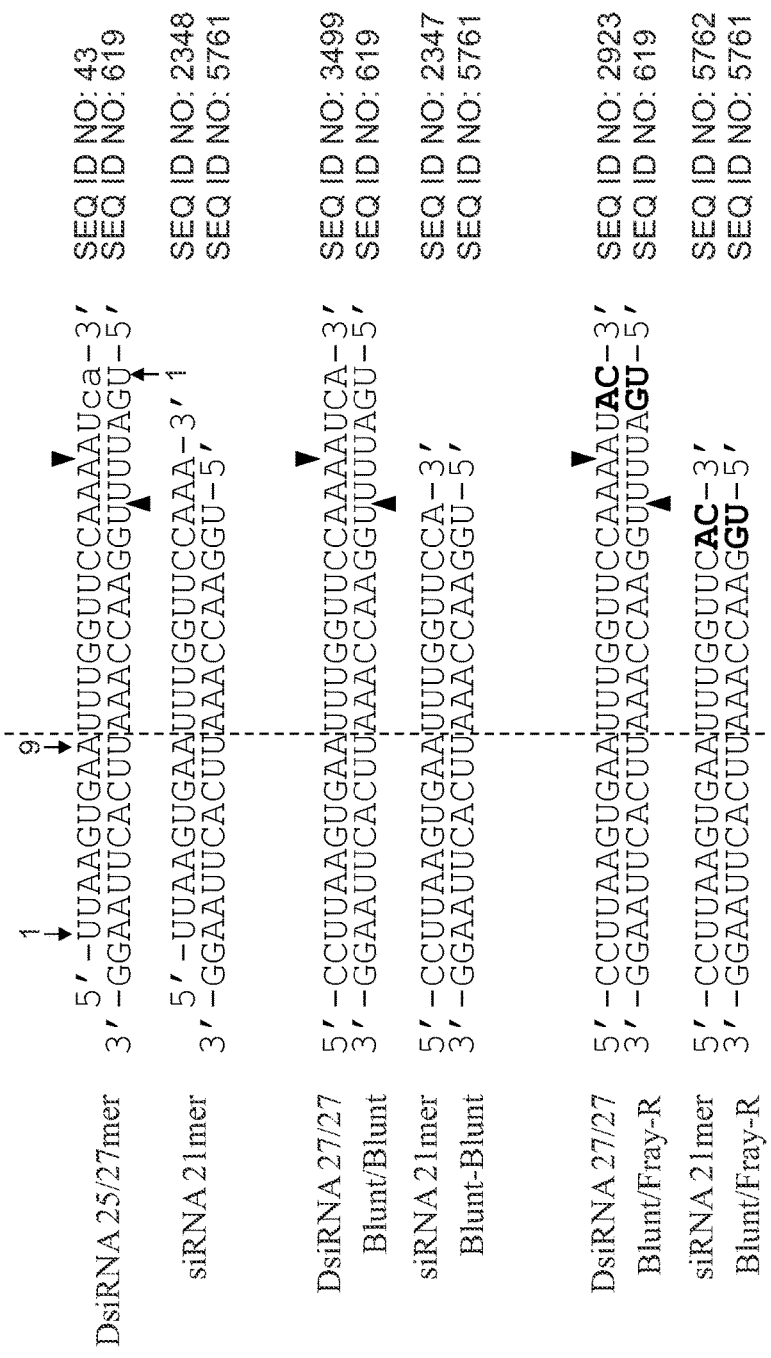

FIG. 2-1

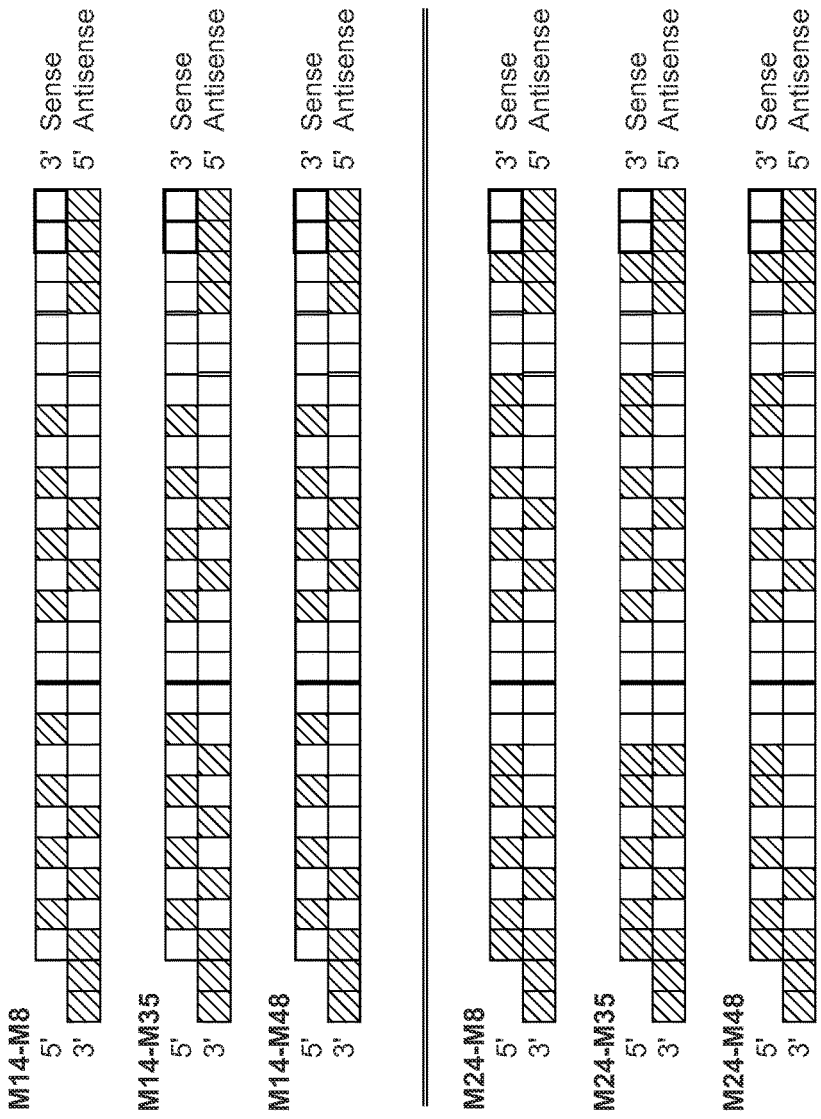
FIG. 2-2  Modification Patterns, Initial Modification Screen (Cont.)

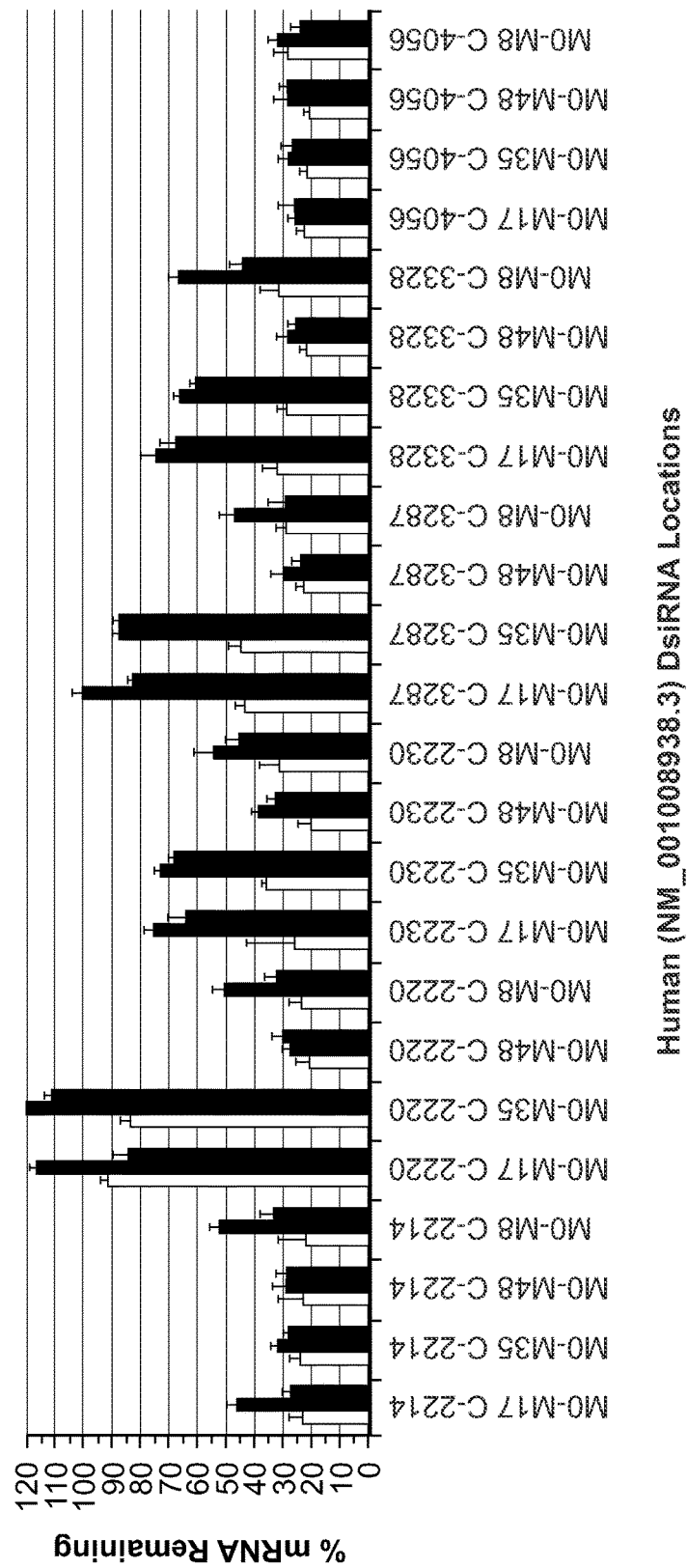

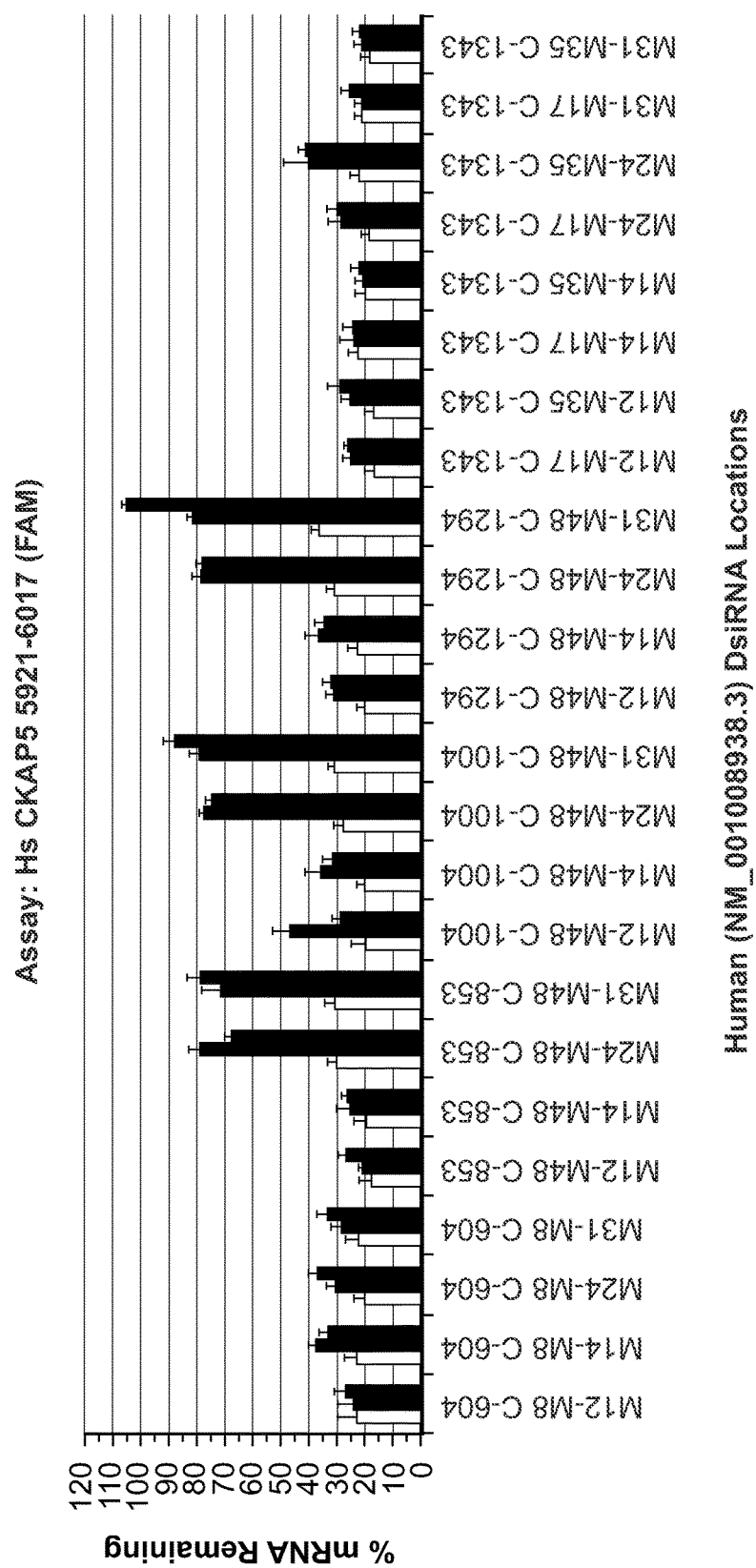

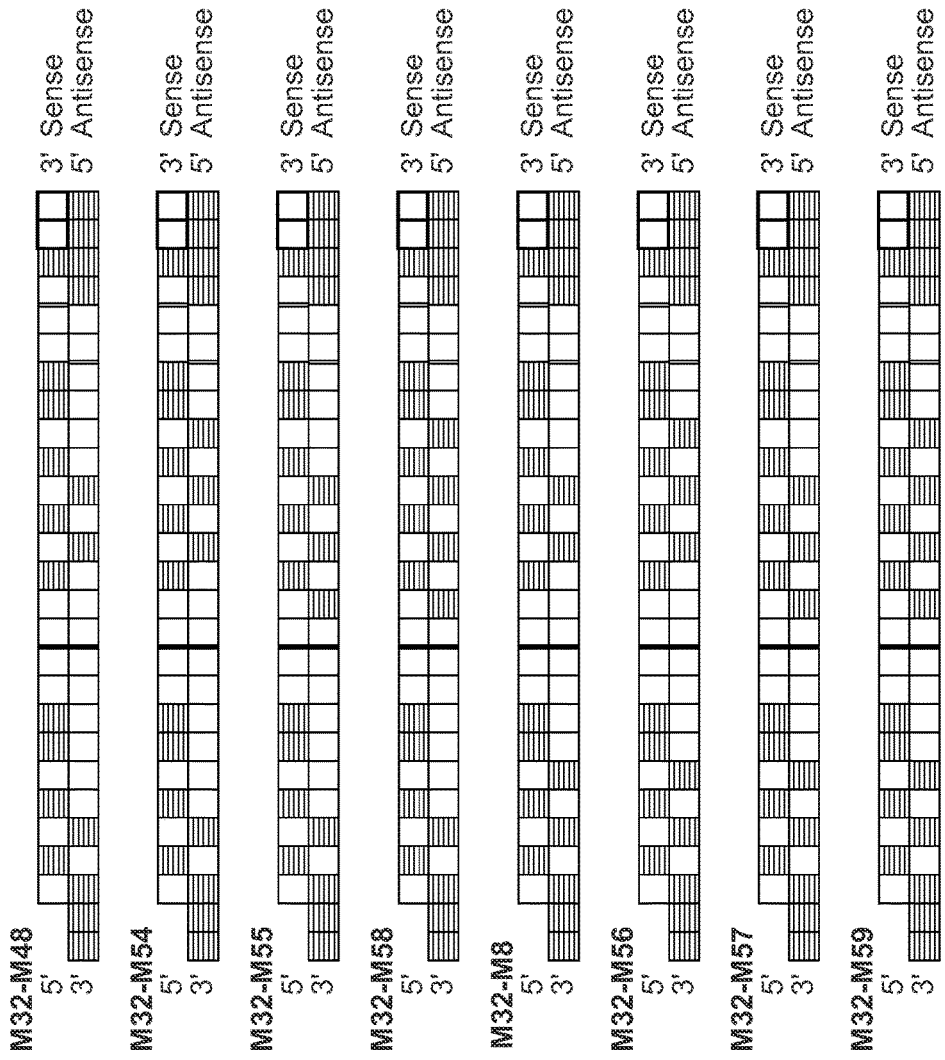
FIG. 6-4    DsiRNA 2'-OMe Modification Patterns, Phase 4.2 (Cont.)

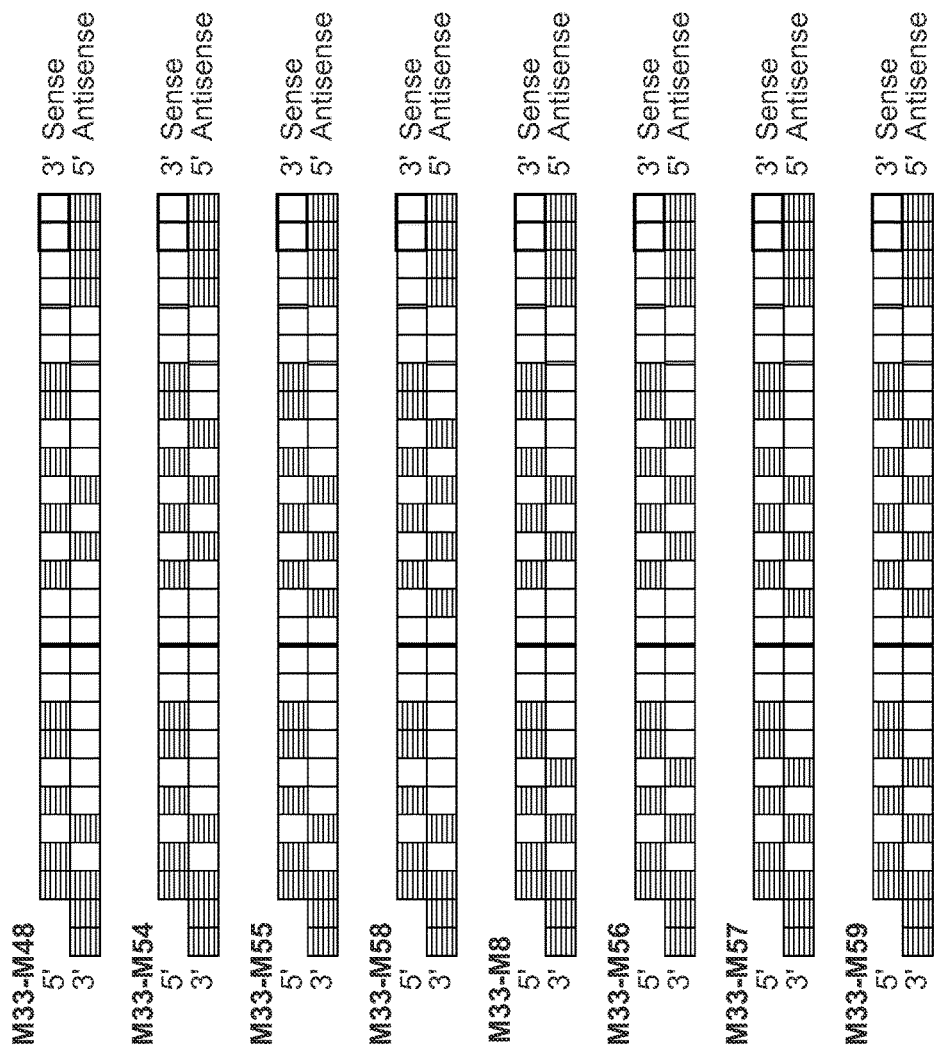
FIG. 6-5  DsiRNA 2'-OMe Modification Patterns, Phase 4.2 (Cont.)

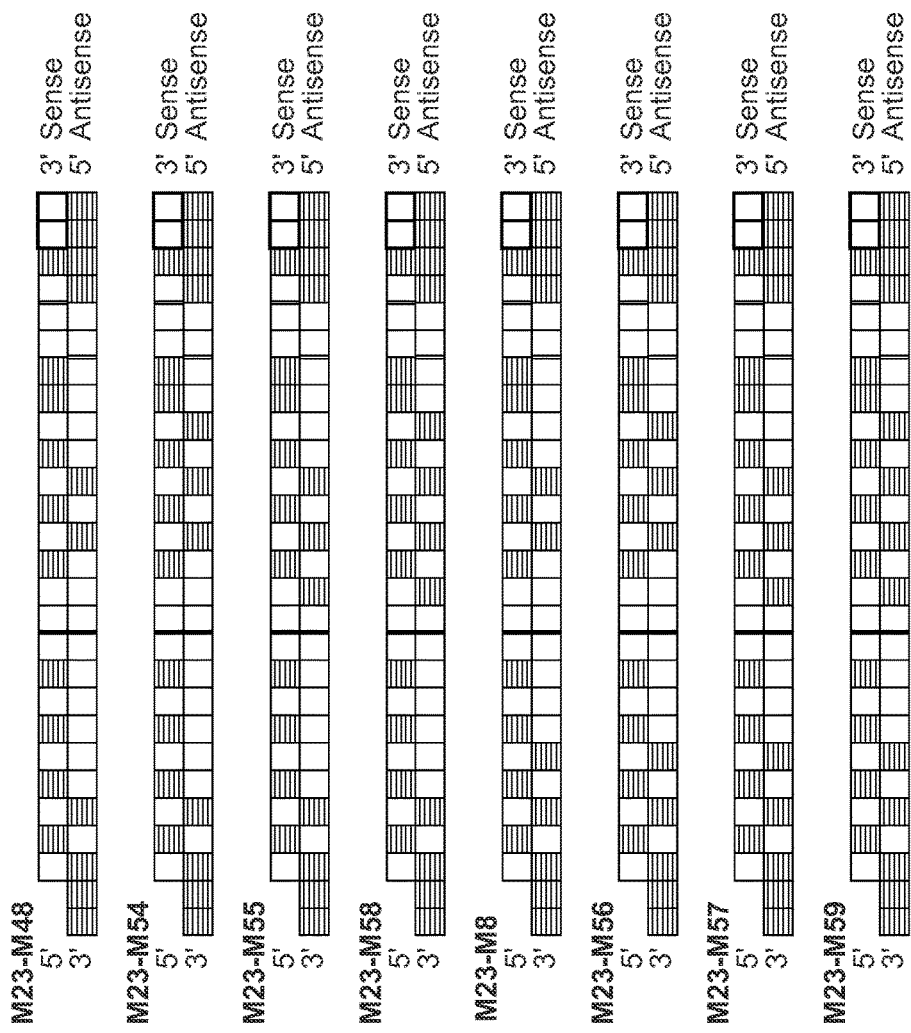
FIG. 6-6  DsiRNA 2'-OMe Modification Patterns, Phase 4.2 (Cont.)

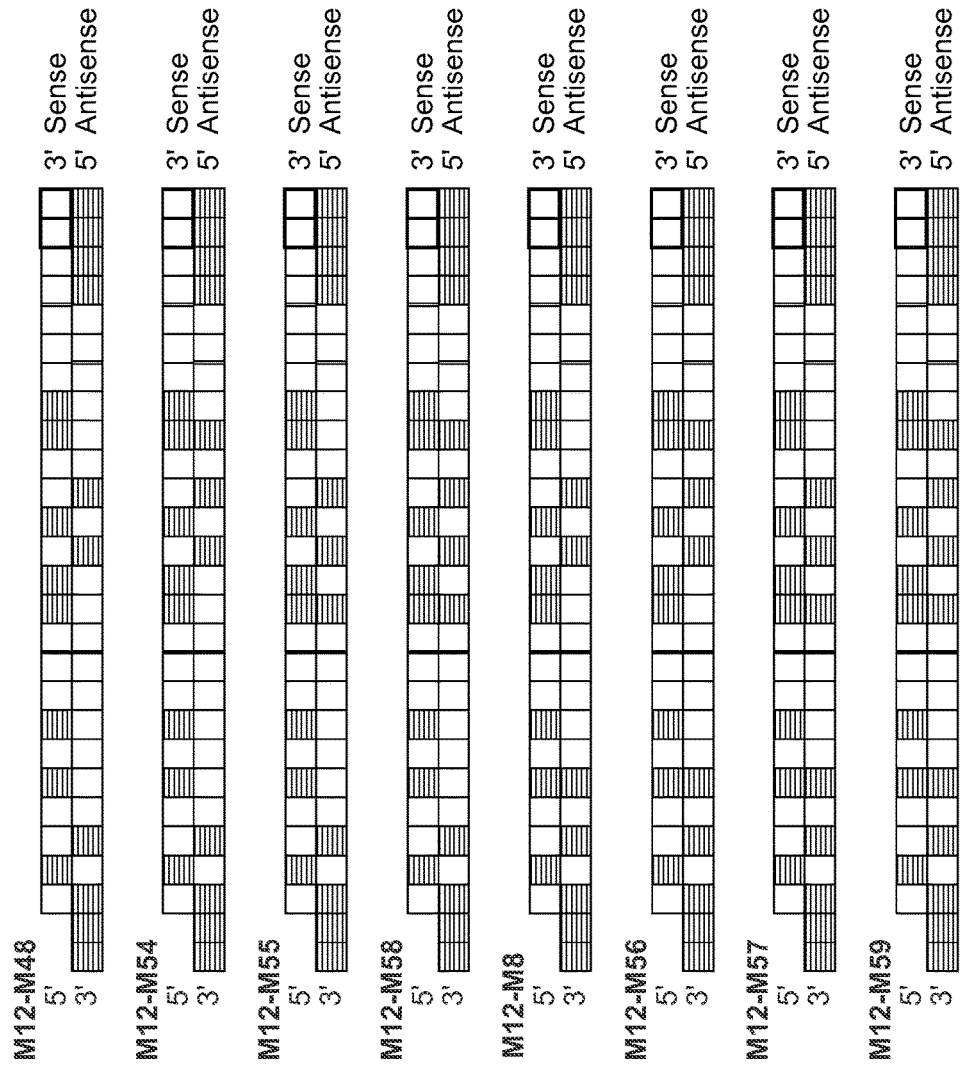
FIG. 6-7  DsiRNA 2'-OMe Modification Patterns, Phase 4.2 (Cont.)

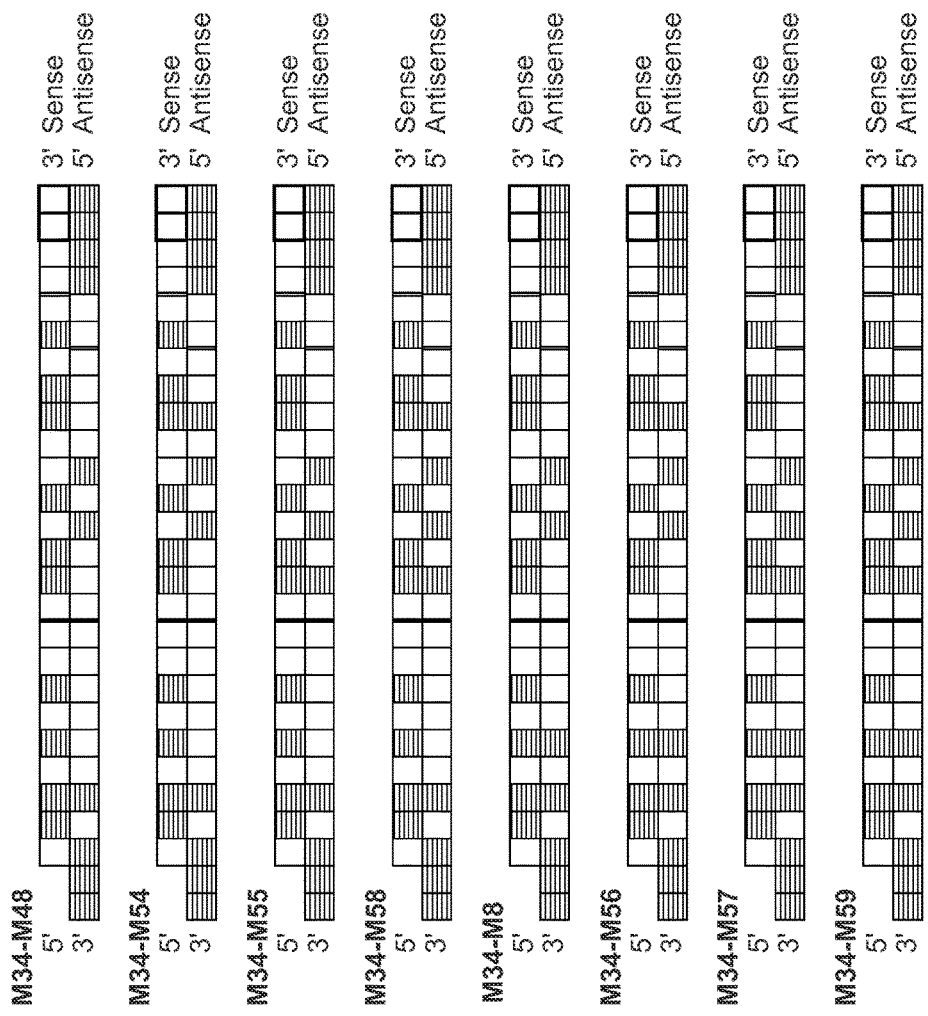
FIG. 6-8    DsiRNA 2'-OMe Modification Patterns, Phase 4.2 (Cont.)

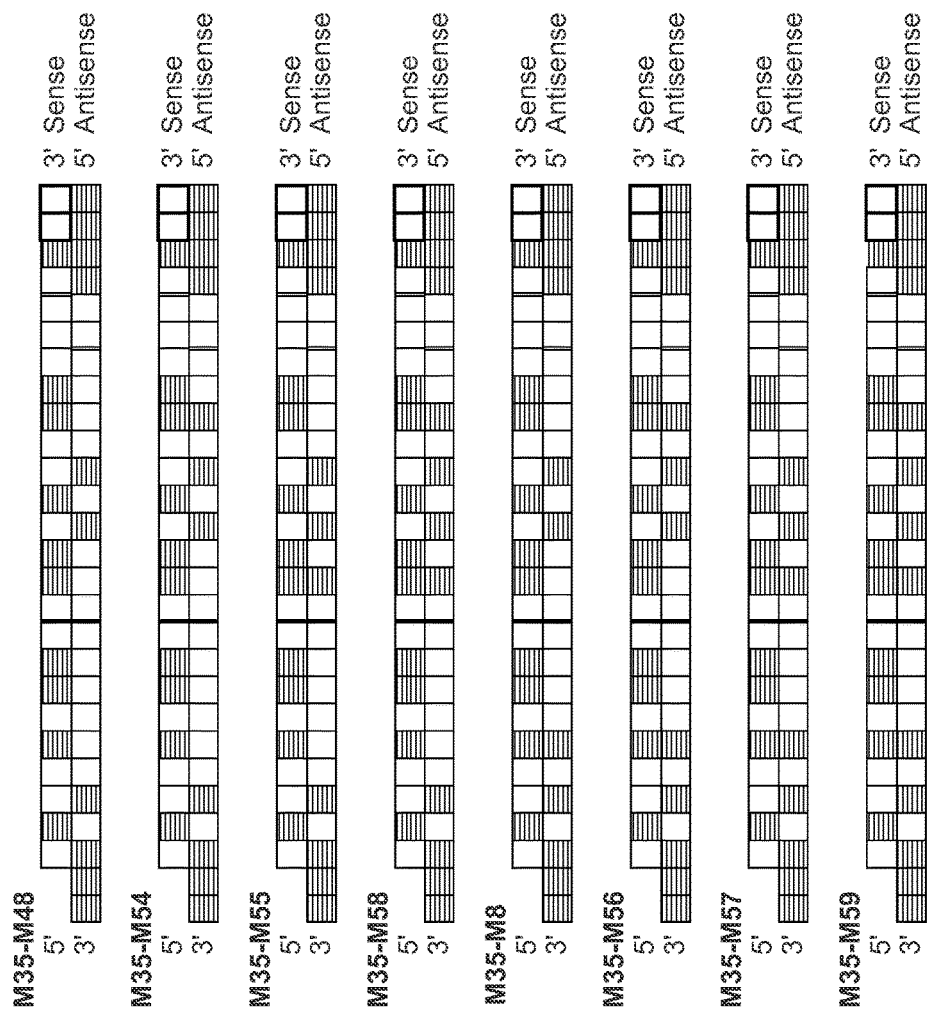
FIG. 6-9   DsiRNA 2'-OMe Modification Patterns, Phase 4.2 (Cont.)

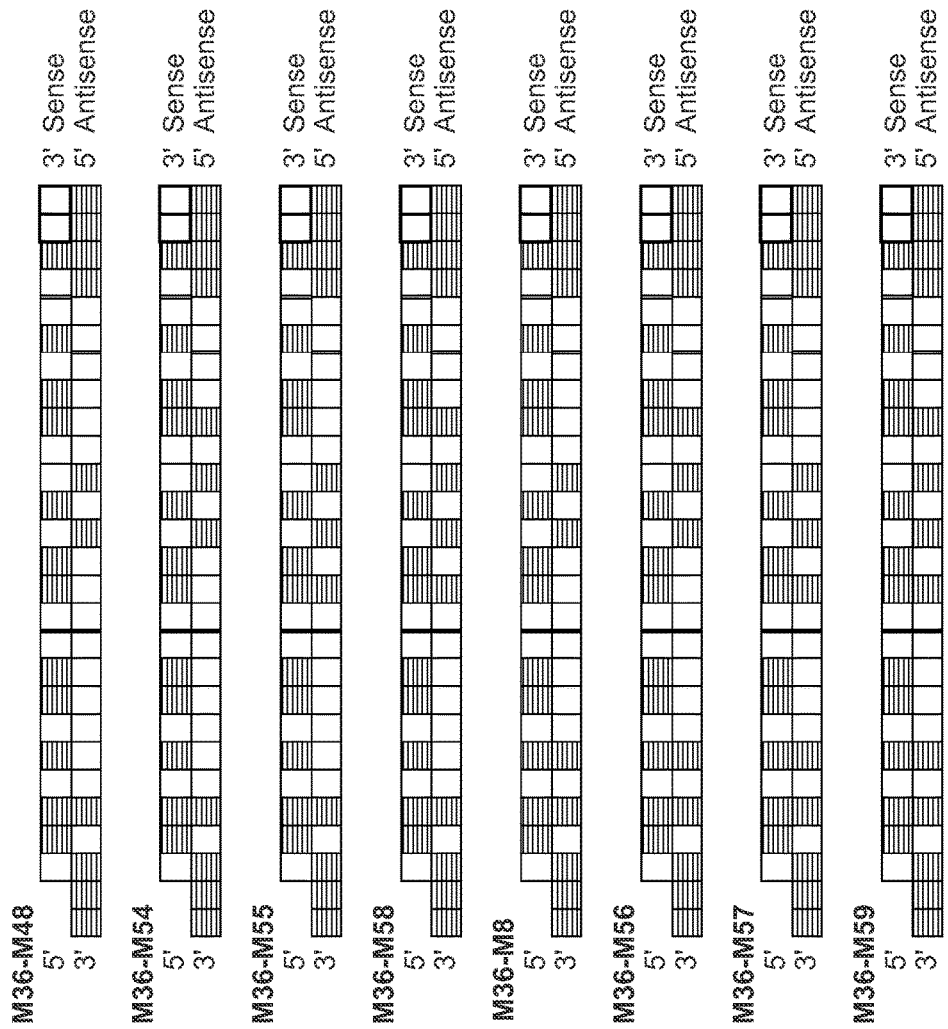
FIG. 6-10 DsiRNA 2'-OMe Modification Patterns, Phase 4.2 (Cont.)

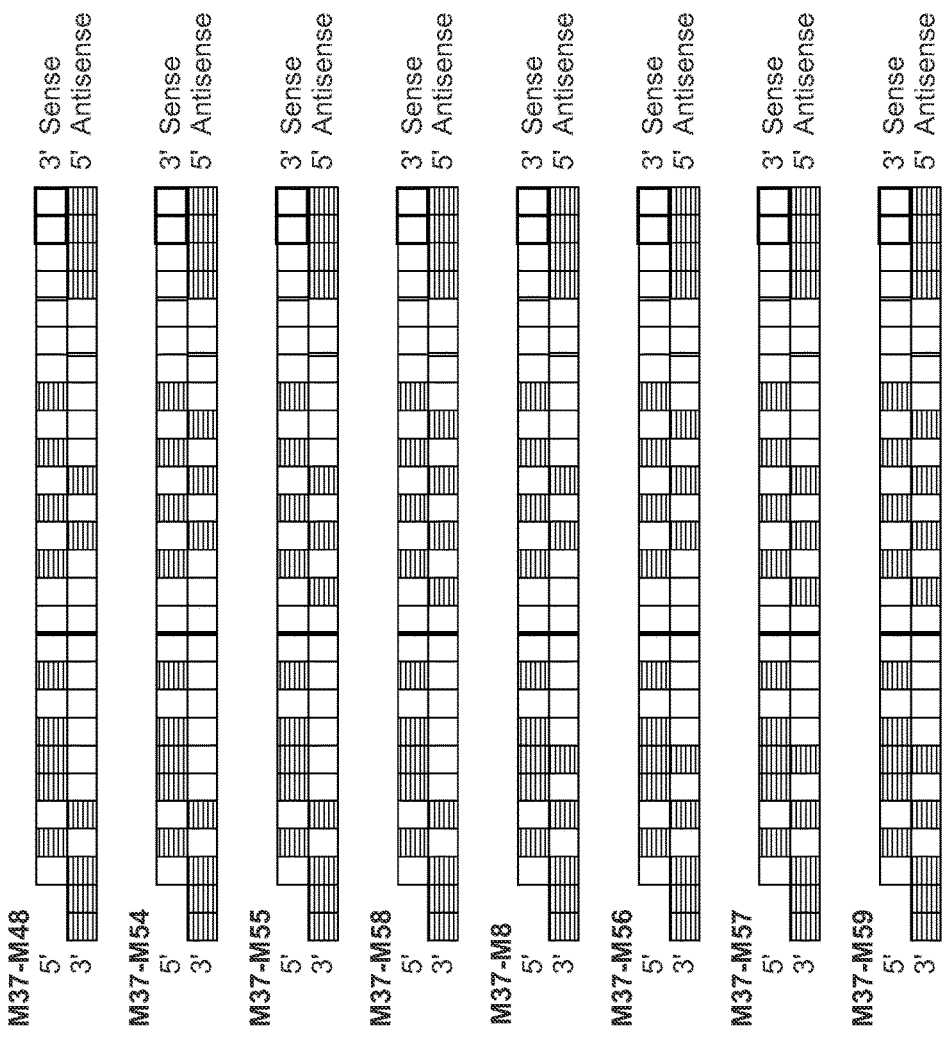
FIG. 6-11  DsiRNA 2'-OMe Modification Patterns, Phase 4.2 (Cont.)

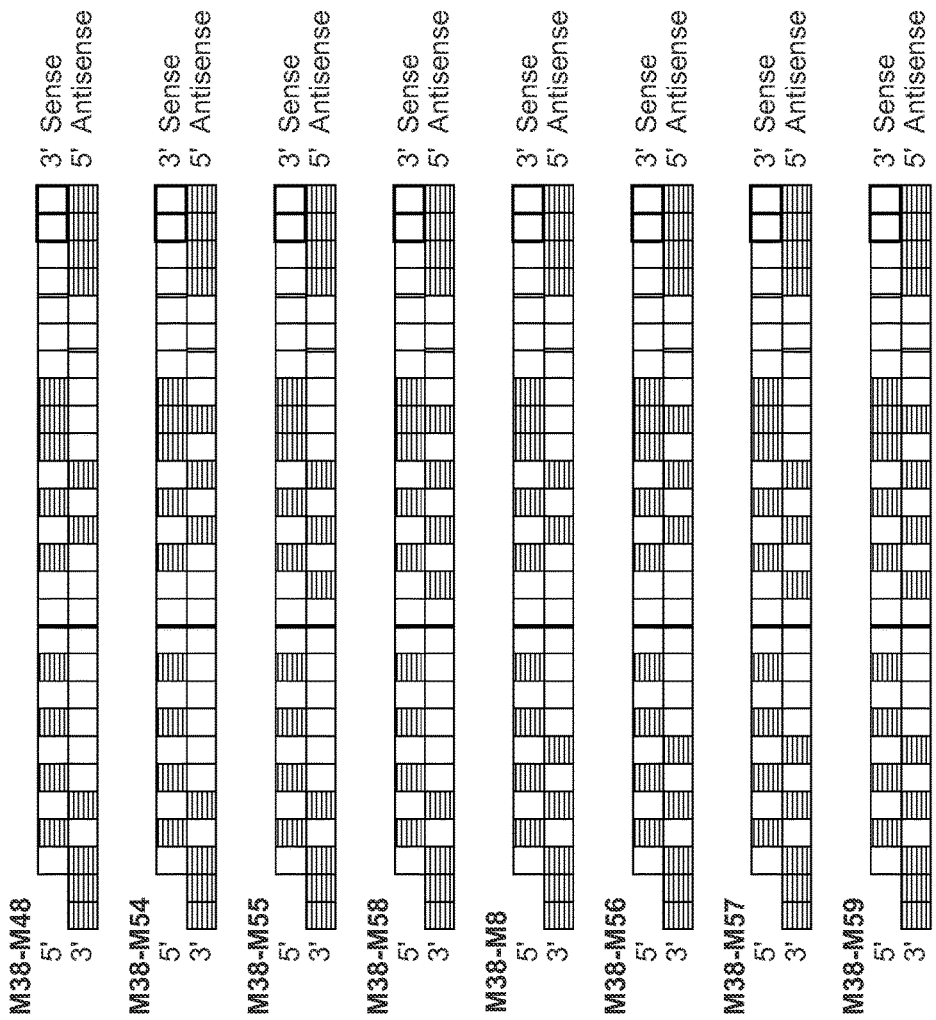
FIG. 6-12  DsiRNA 2'-OMe Modification Patterns, Phase 4.2 (Cont.)

FIG. 6-13  DsiRNA 2'-OMe Modification Patterns, Phase 4.2 (Cont.)

FIG. 6-14  DsiRNA 2'-OMe Modification Patterns, Phase 4.2 (Cont.)

FIG. 6-15

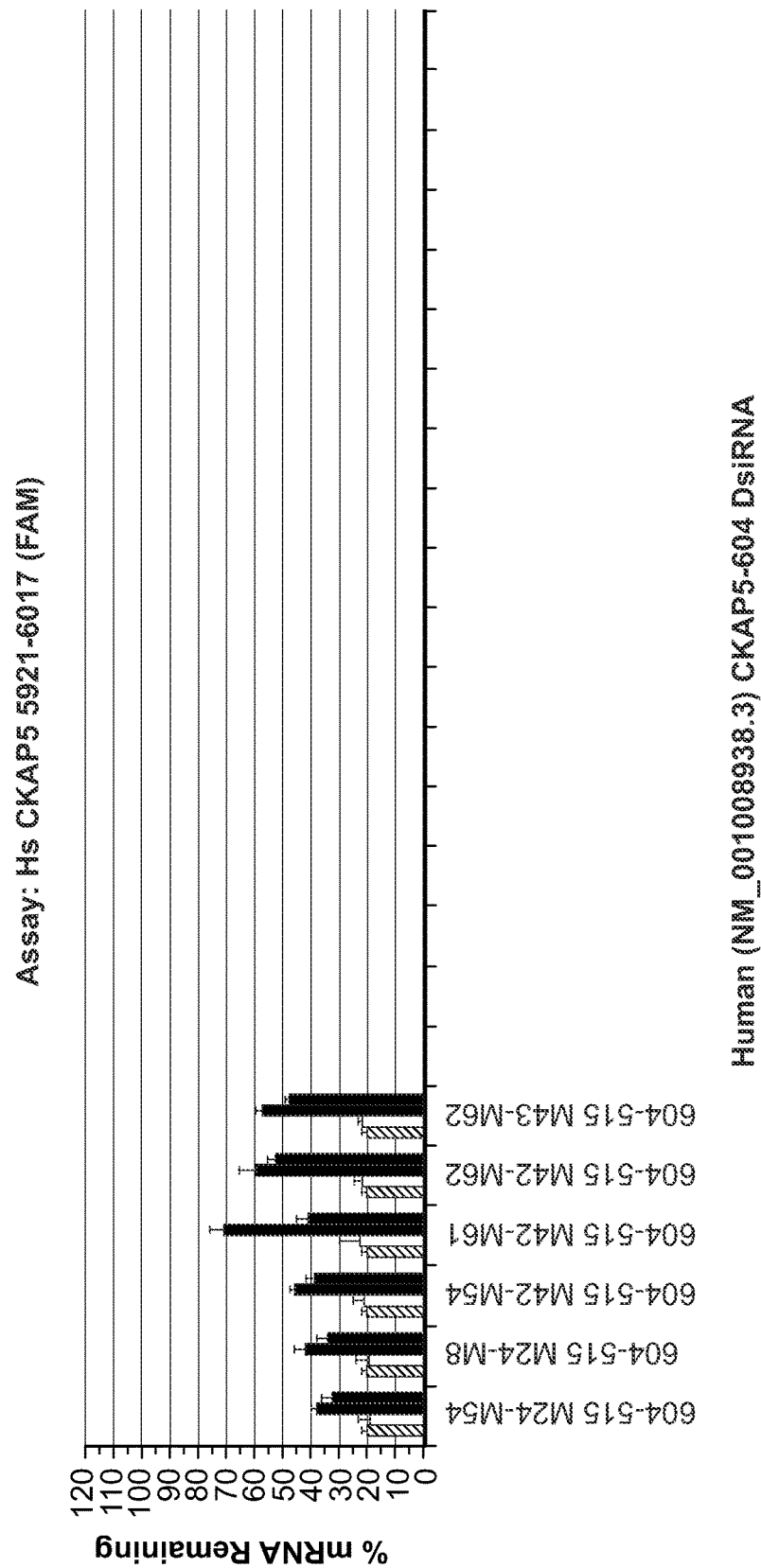

us 9,850,486 B2

METHODS AND COMPOSITIONS FOR THE SPECIFIC INHIBITION OF CKAP5 BY DOUBLE-STRANDED RNA

CROSS REFERENCE TO RELATED APPLICATIONS

This application is the U.S. national phase, pursuant to 35 U.S.C. §371, of international application Ser. No. PCT/US2013/074880, filed Dec. 13, 2013, designating the United States and published in English on Jun. 19, 2014 as publication No. WO 2014/093746 A2, which claims the benefit U.S. Provisional Patent Application Ser. No. 61/737,404, filed Dec. 14, 2012. The entire contents of the aforementioned patent applications are incorporated by reference herein.

FIELD OF THE INVENTION

The present invention relates to compounds, compositions, and methods for the study, diagnosis, and treatment of traits, diseases and conditions that respond to the modulation of CKAP5 (cytoskeleton associated protein 5) gene expression and/or activity.

BACKGROUND OF THE INVENTION

Cytoskeleton-associated protein 5 is a microtubule-associated protein that in humans is encoded by the CKAP5 gene (Nagase et al. *DNA Res.* 2: 37-43; Charrasse et al. *Eur J Biochem* 234: 406-13; "Entrez Gene: CKAP5 cytoskeleton associated protein 5"). CKAP5 is also known as ch-TOG, and the *Xenopus* CKAP5 homolog is XMAP215 (Cassimeris and Morabito. *Molecular Biology of the Cell* 15: 1580-1590).

The CKAP5 protein plays at least two distinct roles in spindle formation: it protects kinetochore microtubules from depolymerization by MCAK (KIF2C), while CKAP5 protein also plays an essential role in centrosomal microtubule assembly, a function independent of MCAK activity (Barr and Gergely. *Molecular and Cellular Biology* 28: 7199-7211). It has also been shown to interact with TACC1, which is a candidate breast cancer gene (Conte et al. *Oncogene* 22: 8102-16; Lauffart et al. *Biochem. J.* 363: 195-200; "Entrez Gene: TACC1 transforming, acidic coiled-coil containing protein 1").

Over-expression of CKAP5 has been observed to occur in certain human hepatomas and colonic tumors (Charrasse et al. *Eur J Biochem* 234: 406-13), and a recent report has proposed CKAP5, as well as additional 20S proteasome subunits MCL1, RRM1 and USP8, to be a molecular vulnerability in human multiple myeloma cells (Tiedemann et al., *Cancer Res.* 72: 757-68).

Double-stranded RNA (dsRNA) agents possessing strand lengths of 25 to 35 nucleotides have been described as effective inhibitors of target gene expression in mammalian cells (Rossi et al., U.S. Patent Application Nos. 2005/0244858 and US 2005/0277610). dsRNA agents of such length are believed to be processed by the Dicer enzyme of the RNA interference (RNAi) pathway, leading such agents to be termed "Dicer substrate siRNA" ("DsiRNA") agents. Additional modified structures of DsiRNA agents were previously described (Rossi et al., U.S. Patent Application No. 2007/0265220).

Provided herein are improved dsRNA agents that target CKAP5. In particular, DsiRNAs targeting CKAP5 have been specifically exemplified.

BRIEF SUMMARY OF THE INVENTION

The present invention is directed to compositions that contain inhibitory nucleic acids, and methods for preparing them. Specific aspects of the invention are directed to double stranded nucleic acids ("dsNAs"), including double stranded ribonucleic acids ("dsRNAs"). The dsNAs of the invention are capable of reducing the expression of a target CKAP5 gene in a cell, either in vitro or in a mammalian subject.

In one aspect, the invention provides an isolated nucleic acid having an oligonucleotide strand 15-35 nucleotides long, where the oligonucleotide strand is sufficiently complementary to a target CKAP5 mRNA sequence of Tables 11-13 along at least 15 nucleotides of the oligonucleotide strand length to reduce CKAP5 target mRNA expression when the nucleic acid is introduced into a mammalian cell.

Another aspect of the invention provides an isolated nucleic acid having an oligonucleotide strand 19-35 nucleotides long, where the oligonucleotide strand is sufficiently complementary to a target CKAP5 mRNA sequence of Tables 14-16 along at least 19 nucleotides of the oligonucleotide strand length to reduce CKAP5 target mRNA expression when the nucleic acid is introduced into a mammalian cell.

An additional aspect of the invention provides an isolated double stranded nucleic acid (dsNA) having first and second nucleic acid strands that include RNA, where the first strand is 15-35 nucleotides long and the second strand of the dsNA is 19-35 nucleotides long, where the second oligonucleotide strand is sufficiently complementary to a target CKAP5 mRNA sequence of Tables 11-13 along at least 15 nucleotides of the second oligonucleotide strand length to reduce CKAP5 target mRNA expression when the dsNA is introduced into a mammalian cell.

A further aspect of the invention provides an isolated dsNA having first and second nucleic acid strands, where the first strand is 15-35 nucleotides long and the second strand of the dsNA is 19-35 nucleotides long, where the second oligonucleotide strand is sufficiently complementary to a target CKAP5 mRNA sequence of Tables 14-16 along at least 19 nucleotides of the second oligonucleotide strand length to reduce CKAP5 target mRNA expression when the dsNA is introduced into a mammalian cell.

Another aspect of the invention provides an isolated dsNA having first and second nucleic acid strands, where the first strand is 15-35 nucleotides long and the second strand of the dsNA is 19-35 nucleotides long, where the second oligonucleotide strand is sufficiently complementary to a target CKAP5 mRNA sequence of Tables 17-19 along at least 19 nucleotides of the second oligonucleotide strand length to reduce CKAP5 target mRNA expression, and starting from the 5' end of the CKAP5 mRNA sequence of Tables 17-19 (position 1), mammalian Ago2 cleaves the mRNA at a site between positions 9 and 10 of the sequence, when the dsNA is introduced into a mammalian cell.

An additional aspect of the invention provides an isolated dsNA molecule that consists of a sense region and an antisense region, where the sense region and the antisense region together form a duplex region consisting of 25-35 base pairs and the antisense region includes a sequence that is the complement of a sequence of Tables 8-10, and the dsNA also possesses from zero to two 3' overhang regions, where each overhang region is six or fewer nucleotides long.

Another aspect of the invention provides an isolated dsNA having first and second nucleic acid strands and a duplex region of at least 25 base pairs, where the first strand is 25-34 nucleotides long and the second strand of the dsNA is 26-35 nucleotides long and includes 1-5 single-stranded nucleotides at its 3' terminus, where the second oligonucleotide strand is sufficiently complementary to a target CKAP5 mRNA sequence of Tables 8-10 along at least 19 nucleotides of the second oligonucleotide strand length to reduce CKAP5 target gene expression when the dsNA is introduced into a mammalian cell.

A further aspect of the invention provides an isolated dsNA having first and second nucleic acid strands and a duplex region of at least 25 base pairs, where the first strand is 25-34 nucleotides long and the second strand of the dsNA is 26-35 nucleotides long and includes 1-5 single-stranded nucleotides at its 3' terminus, where the 3' terminus of the first oligonucleotide strand and the 5' terminus of the second oligonucleotide strand form a blunt end, and the second oligonucleotide strand is sufficiently complementary to a target CKAP5 sequence of SEQ ID NOs: 3457-4032, 2305-2880 and 4033-5760 along at least 19 nucleotides of the second oligonucleotide strand length to reduce CKAP5 mRNA expression when the dsNA is introduced into a mammalian cell.

In one embodiment, an isolated dsNA of the invention has a duplex region of at least 25 base pairs, 19-21 base pairs or 21-25 base pairs. In another embodiment, the second oligonucleotide strand includes 1-5 single-stranded nucleotides at its 3' terminus.

In additional embodiments, the first strand and/or the second strand is 25-35 nucleotides long.

In one embodiment, the second oligonucleotide strand is complementary to a target CKAP5 cDNA sequence of GenBank Accession Nos. NM_001008938.3 and NM_014756.3 along at most 27 nucleotides of the second oligonucleotide strand length.

In certain embodiments, the invention also provides for an isolated dsNA where the first strand is 26-35 nucleotides long, 27-35 nucleotides long, 28-35 nucleotides long, 29-35 nucleotides long, 30-35 nucleotides long, 31-35 nucleotides long, 33-35 nucleotides long, 34-35 nucleotides long, 17-35 nucleotides long, 19-35 nucleotides long, 21-35 nucleotides long, 23-35 nucleotides long, 17-33 nucleotides long, 17-31 nucleotides long, 17-29 nucleotides long, 17-27 nucleotides long, 21-35 nucleotides long or 19-33 nucleotides long.

The invention also provides for an isolated dsNA where the second strand is 26-35 nucleotides long, 27-35 nucleotides long, 28-35 nucleotides long, 29-35 nucleotides long, 30-35 nucleotides long, 31-35 nucleotides long, 33-35 nucleotides long, 34-35 nucleotides long, 21-35 nucleotides long, 23-35 nucleotides long, 25-35 nucleotides long, 27-35 nucleotides long, 19-33 nucleotides long, 19-31 nucleotides long, 19-29 nucleotides long, 19-27 nucleotides long or 19-25 nucleotides long.

In other embodiments, the invention provides for an isolated dsNA where each of the first and second strands is at least 27 nucleotides long, at least 28 nucleotides long, at least 29 nucleotides long, at least 30 nucleotides long, at least 31 nucleotides long, at least 32 nucleotides long, at least 33 nucleotides long, at least 34 nucleotides long or at least 35 nucleotides long.

Optionally, each of the first and the second strands is at least 27 and at most 30 nucleotides long, at least 28 and at most 30 nucleotides long and at least 29 and at most 30 nucleotides long.

The invention also provides for an isolated dsNA that is sufficiently complementary to a target CKAP5 mRNA sequence along at least 15, 16, 17, 18, 19, 20, 21, 22, 23, 24, 25 or more nucleotides of the second oligonucleotide strand length to reduce CKAP5 target mRNA expression when the dsNA is introduced into a mammalian cell.

In one embodiment, an isolated nucleic acid (optionally, a dsNA) of the invention includes a modified nucleotide, with the modified nucleotide optionally a 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2) 2-O-2'-bridge, 2'-LNA, 2'-amino or a 2'-O—(N-methylcarbamate).

In certain embodiments, starting from the first nucleotide (position 1) at the 3' terminus of the first oligonucleotide strand of a dsNA of the invention, position 1, 2 and/or 3 is substituted with a modified nucleotide. Optionally, the modified nucleotide residue of the 3' terminus of the first strand is a deoxyribonucleotide, an acyclonucleotide or a fluorescent molecule. In related embodiments, position 1 of the 3' terminus of the first oligonucleotide strand is a deoxyribonucleotide.

In one embodiment, the nucleotides of a dsNA of the invention having 1-5 single-stranded nucleotides of the 3' terminus of the second strand include a modified nucleotide, which is optionally a 2'-O-methyl ribonucleotide. In a related embodiment, all nucleotides of the 1-5 single-stranded nucleotides of the 3' terminus of the second strand are modified nucleotides.

In certain embodiments, the 3' terminus of the first strand of a dsNA of the invention and the 5' terminus of the second strand form a blunt end. In one embodiment, the first strand is 25 nucleotides long and the second strand is 27 nucleotides long.

In certain embodiments, starting from the 5' end of a CKAP5 mRNA sequence of Table 8 (position 1), mammalian Ago2 cleaves the mRNA at a site between positions 9 and 10 of the sequence, thereby reducing CKAP5 target mRNA expression when the dsNA is introduced into a mammalian cell. In another embodiment, starting from the 5' end of the CKAP5 mRNA sequence of SEQ ID NOs: 3457-4032, 2305-2880 and 4033-5760, mammalian Ago2 cleaves the mRNA at a site between positions 9 and 10 of the cDNA sequence, thereby reducing CKAP5 target mRNA expression when the dsNA is introduced into a mammalian cell.

In another embodiment, the second strand includes a sequence of SEQ ID NOs: 577-1152. Optionally, the first strand includes a sequence of SEQ ID NOs: 1-576 and 1729-2304.

In certain embodiments, a dsNA of the invention possesses a pair of first strand/second strand sequences shown in Table 2.

In one embodiment, each of the first and the second strands of a dsNA of the invention is at least 26 nucleotides long.

In another embodiment, the nucleotides of a dsNA of the invention having 1-5 single-stranded nucleotides of the 3' terminus of the second strand are 1-3 nucleotides long, optionally 1-2 nucleotides long. In a related embodiment, the 1-5 single-stranded nucleotides of the 3' terminus of the second strand is two nucleotides long and includes a 2'-O-methyl modified ribonucleotide.

In one embodiment, a dsNA of the invention has a second oligonucleotide strand possessing a modification pattern of AS-M1 to AS-M52 and AS-M1* to AS-M52*.

In another embodiment, the first oligonucleotide strand of a nucleic acid of the invention includes a modification pattern of SM1 to SM31.

In one embodiment, each of the first and the second strands of a dsNA of the invention has a length which is at least 26 and at most 30 nucleotides.

Optionally, a dsNA of the invention is cleaved endogenously in the cell by Dicer.

In one embodiment, the amount of the isolated nucleic acid sufficient to reduce expression of the target gene is 1 nanomolar or less, 200 picomolar or less, 100 picomolar or less, 50 picomolar or less, 20 picomolar or less, 10 picomolar or less, 5 picomolar or less, 2, picomolar or less or 1 picomolar or less in the environment of the cell.

In certain embodiments, an isolated dsNA of the invention having 25 nucleotide or longer strand lengths possesses greater potency than an isolated 21mer siRNA directed to the identical target CKAP5 mRNA sequence in reducing target CKAP5 mRNA expression when assayed in vitro in a mammalian cell at an effective concentration in the environment of a cell of 1 nanomolar or less.

In one embodiment, an isolated dsNA of the invention is sufficiently complementary to the target CKAP5 mRNA sequence to reduce CKAP5 target mRNA expression by an amount (expressed by %) of at least 10%, at least 50%, at least 80-90%, at least 95%, at least 98%, or at least 99% when the dsNA is introduced into a mammalian cell.

In certain embodiments, the first and second strands of a dsNA of the invention are joined by a chemical linker. Optionally, the 3' terminus of the first strand and the 5' terminus of the second strand are joined by a chemical linker.

In some embodiments, a nucleotide of the second or first strand of a dsNA of the invention is substituted with a modified nucleotide that directs the orientation of Dicer cleavage. In one embodiment, an isolated nucleic acid of the invention possesses a modified nucleotide that is a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (TC), a 2',3'-didehydro-2',3'-dideoxythymidine (dT), a monophosphate nucleotide of 3'-azido-3'-deoxythymidine (AZT), a 2',3'-dideoxy-3'-thiacytidine (TC) and a monophosphate nucleotide of 2',3'-didehydro-2',3'-dideoxythymidine (dT), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and/or a locked nucleic acid. In a related embodiment, the isolated nucleic acid includes a morpholino nucleic acid or a peptide nucleic acid (PNA) modification. In another embodiment, the isolated nucleic acid possesses a phosphate backbone modification which is a phosphonate, a phosphorothioate and/or a phosphotriester.

Another aspect of the invention provides a method for reducing expression of a target CKAP5 gene in a mammalian cell involving contacting a mammalian cell in vitro with an isolated nucleic acid of the invention in an amount sufficient to reduce expression of a target CKAP5 mRNA in the cell.

In one embodiment, target CKAP5 mRNA expression is reduced by an amount (expressed by %) of at least 10%, at least 50% and at least 80-90%. Optionally, CKAP5 mRNA levels are reduced by an amount (expressed by %) of at least 90% at least 8 days after the cell is contacted with the nucleic acid. In certain embodiments, CKAP5 mRNA levels are reduced by an amount (expressed by %) of at least 70% at least 10 days after the cell is contacted with the nucleic acid.

An additional aspect of the invention provides a method for reducing expression of a target CKAP5 mRNA in a mammal involving administering an isolated nucleic acid of the invention to a mammal in an amount sufficient to reduce expression of a target CKAP5 mRNA in the mammal.

In one embodiment, the isolated nucleic acid is administered at a dosage of 1 microgram to 5 milligrams per kilogram of the mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

In another embodiment, CKAP5 mRNA levels are reduced in a tissue of the mammal by an amount (expressed by %) of at least 70% at least 3 days after the isolated dsNA is administered to the mammal.

Optionally, the tissue is renal, breast, lung, ovarian, liver, cervical, esophageal, oropharyngeal or pancreatic tissue.

In one embodiment, the administering step involves intravenous injection, intramuscular injection, intraperitoneal injection, infusion, subcutaneous injection, transdermal, aerosol, rectal, vaginal, topical, oral or inhaled delivery.

A further aspect of the invention provides a method for selectively inhibiting the growth of a cell involving contacting the cell with an amount of an isolated nucleic acid of the invention sufficient to inhibit the growth of the cell.

In one embodiment, the cell is a tumor cell of a subject. In certain embodiments, the cell is a tumor cell in vitro. Optionally, the cell is a human cell.

An additional aspect of the invention provides a formulation that includes an isolated nucleic acid of the invention, where the nucleic acid is present in an amount effective to reduce target CKAP5 mRNA levels when the nucleic acid is introduced into a mammalian cell in vitro by an amount (expressed by %) of at least 10%, at least 50% and at least 80-90%. In one embodiment, the effective amount is 1 nanomolar or less, 200 picomolar or less, 100 picomolar or less, 50 picomolar or less, 20 picomolar or less, 10 picomolar or less, 5 picomolar or less, 2, picomolar or less or 1 picomolar or less in the environment of the cell.

Optionally, a dsNA of the invention is present in an amount effective to reduce target CKAP5 mRNA levels when the dsNA is introduced into a cell of a mammalian subject by an amount (expressed by %) of at least 10%, at least 50% and at least 80-90%. In certain embodiments, the effective amount is a dosage of 1 microgram to 5 milligrams per kilogram of the subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, or 0.1 to 2.5 micrograms per kilogram.

Another aspect provides a mammalian cell containing an isolated nucleic acid of the invention. A further aspect provides a pharmaceutical composition that includes an isolated nucleic acid of the invention and a pharmaceutically acceptable carrier. An additional aspect provides a kit containing an isolated nucleic acid of the invention and instructions for its use.

One aspect of the invention provides a method for treating or preventing a CKAP5-associated disease or disorder in a subject involving administering an isolated nucleic acid of the invention and a pharmaceutically acceptable carrier to the subject in an amount sufficient to treat or prevent the CKAP5-associated disease or disorder in the subject, thereby treating or preventing the CKAP5-associated disease or disorder in the subject.

In one embodiment, the CKAP5-associated disease or disorder is renal, breast, lung, ovarian, liver, cervical, esophageal, oropharyngeal or pancreatic cancer.

Another aspect of the invention provides a composition possessing CKAP5 inhibitory activity consisting essentially of an isolated nucleic acid of the invention.

The present invention is also directed to compounds, compositions, and methods relating to traits, diseases and conditions that respond to the modulation of expression and/or activity of genes involved in CKAP5 gene expression pathways or other cellular processes that mediate the maintenance or development of such traits, diseases and conditions. In certain aspects, the invention relates to small nucleic acid molecules that are capable of being processed by the Dicer enzyme, such as Dicer substrate siRNAs (DsiRNAs) capable of mediating RNA interference (RNAi) against CKAP5 gene expression. The anti-CKAP5 dsRNAs of the invention are useful, for example, in providing compositions for treatment of traits, diseases and conditions that can respond to modulation of CKAP5 in a subject, such as cancer and/or other proliferative diseases, disorders, or conditions. Efficacy, potency, toxicity and other effects of an anti-CKAP5 dsRNA can be examined in one or more animal models of proliferative disease (exemplary animal models of proliferative disease are recited below).

BRIEF DESCRIPTION OF THE DRAWINGS

FIG. 1 shows the structures of exemplary DsiRNA agents of the invention targeting a site in the CKAP5 RNA referred to herein as the "CKAP5-6704" target site. UPPER case=unmodified RNA, lower case=DNA, Bold=mismatch base pair nucleotides; arrowheads indicate projected Dicer enzyme cleavage sites; dashed line indicates sense strand (top strand) sequences corresponding to the projected Argonaute 2 (Ago2) cleavage site within the targeted CKAP5 sequence.

FIGS. 2-1 to 2-6 present data obtained in an initial modified duplex screen. FIGS. 2-1 and 2-2 depict 2'-O-methyl modification patterns of both passenger and guide strands of tested duplexes, while FIGS. 2-3 to 2-6 show histograms of human (FIGS. 2-3 and 2-4) and mouse (FIGS. 2-5 and 2-6) CKAP5 inhibitory efficacies observed for indicated DsiRNAs. "P1" indicates phase 1 (primary screen), while "1M" indicates the initial modification screen. In phase 1, DsiRNAs were tested at 1 nM in the environment of human HeLa cells. In the initial modification screen, DsiRNAs were tested at 1 nM and at 0.1 nM (in duplicate) in the environment of human HeLa cells (FIGS. 2-3 and 2-4) and mouse (FIGS. 2-5 and 2-6) Hepa 1-6 cells. Individual bars represent average human or mouse CKAP5 levels observed in triplicate, with standard errors shown. Human CKAP5 levels were normalized to HPRT and SFRS9 levels, while mouse CKAP5 levels were normalized to HPRT and RPL23.

FIGS. 3-1 to 3-8 show histograms of human and mouse CKAP5 inhibitory efficacies observed for indicated DsiRNAs. "P1" indicates phase 1 (primary screen), while "P2" indicates phase 2. In phase 1, DsiRNAs were tested at 1 nM in the environment of human HeLa cells (human cell assays; FIGS. 3-1 to 3-4). In phase 2, DsiRNAs were tested at 1 nM and at 0.1 nM (in duplicate) in the environment of human HeLa cells (FIGS. 3-1 to 3-4) or mouse Hepa 1-6 cells (FIGS. 3-5 to 3-8). Individual bars represent average human (FIGS. 3-1 to 3-4) or mouse (FIGS. 3-5 to 3-8) CKAP5 levels observed in triplicate, with standard errors shown. Human CKAP5 levels were normalized to HPRT and SFRS9 levels, while mouse CKAP5 levels were normalized to HPRT and RPL23 levels.

FIGS. 4-1 to 4-9 present data showing levels of CKAP5 knockdown observed for 24 CKAP5-targeting duplex sequences possessing a range of guide strand 2'-O-methyl modifications, as depicted in FIG. 4-1. Bar graphs of FIGS. 4-2 to 4-9 show efficacy data for the 24 independent CKAP5-targeting DsiRNAs across different, indicated guide (antisense) strand 2'-O-methyl modification patterns in human HeLa cells (FIGS. 4-2 to 4-5) and mouse Hepa 1-6 cells (FIGS. 4-6 to 4-9) at 0.1 nM (in duplicate) and at 1 nM.

FIGS. 5-1 to 5-6 present data obtained in an expanded modified duplex screen. FIGS. 5-1 and 5-2 depict 2'-O-methyl modification patterns of both passenger and guide strands of tested duplexes, while FIGS. 5-3 to 5-6 show histograms of human CKAP5 inhibitory efficacies observed for indicated DsiRNAs in human cells. "P4" indicates phase 4 (expanded modified duplex screen). In the expanded modification screen, DsiRNAs were tested at 1 nM and at 0.1 nM (in duplicate) in the environment of human HeLa cells. Individual bars represent average human CKAP5 levels observed in triplicate, with standard errors shown. Human CKAP5 levels were normalized to HPRT and SFRS9 levels.

FIGS. 6-1 to 6-20 present 2'-O-methyl modification patterns and data obtained in a further modified duplex screen performed upon CKAP5-853 and CKAP5-604 DsiRNAs. FIGS. 6-1 and 6-2 depict 2'-O-methyl modification patterns of passenger (FIG. 6-1) and guide (FIG. 6-2) strands of tested duplexes, respectively. FIGS. 6-3 to 6-14 show 2'-O-methyl modification patterns of both passenger and guide strands of DsiRNAs. FIG. 6-15 depicts passenger strand and guide strand modification patterns as applied to the CKAP5-853 duplex. FIGS. 6-16 through 6-19 show histograms of human CKAP5 inhibitory efficacies observed for indicated modified CKAP5-853 duplexes (including a duplex harboring a mismatch with respect to the target CKAP5 mRNA) in human cells. FIG. 6-20 presents histograms of human CKAP5 inhibitory efficacies observed for indicated modified CKAP5-604 duplexes in human cells. "P4.2" indicates phase 4.2 (further modified duplex screen). In this further modification screen, DsiRNAs were tested at 1 nM and at 0.1 nM (in duplicate) in the environment of human HeLa cells. Individual bars represent average human CKAP5 levels observed in triplicate, with standard errors shown. Human CKAP5 levels were normalized to HPRT and SFRS9 levels.

DETAILED DESCRIPTION OF THE INVENTION

Figures 2, 3, 3A:
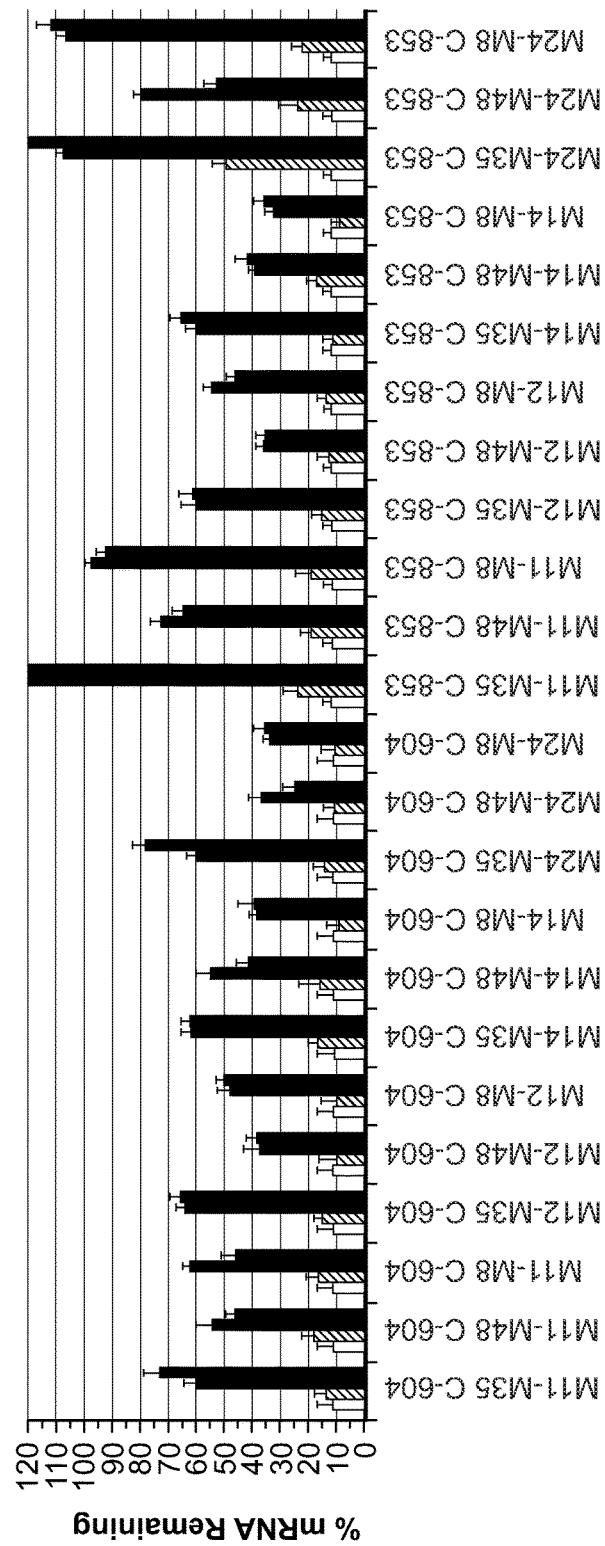
Figures 2, 3, 3B:
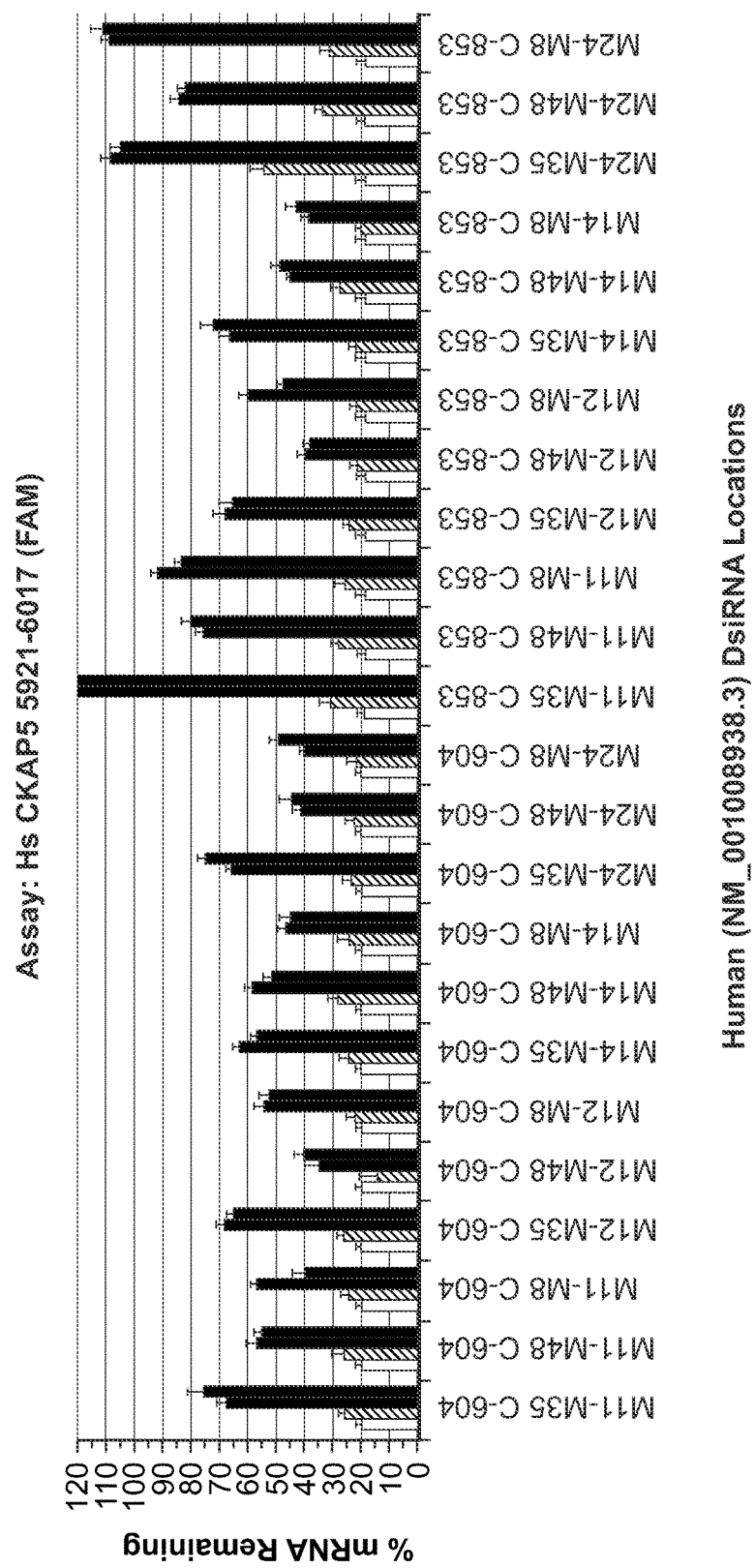

The present invention is directed to compositions that contain double stranded RNA ("dsRNA"), and methods for preparing them, that are capable of reducing the level and/or expression of the CKAP5 gene in vivo or in vitro. One of the strands of the dsRNA contains a region of nucleotide sequence that has a length that ranges from 19 to 35 nucleotides that can direct the destruction and/or translational inhibition of the targeted CKAP5 transcript.

Definitions

Unless defined otherwise, all technical and scientific terms used herein have the meaning commonly understood by a person skilled in the art to which this invention belongs. The following references provide one of skill with a general definition of many of the terms used in this invention: Singleton et al., Dictionary of Microbiology and Molecular Biology (2nd ed. 1994); The Cambridge Dictionary of Science and Technology (Walker ed., 1988); The Glossary of Genetics, 5th Ed., R. Rieger et al. (eds.), Springer Verlag (1991); and Hale & Marham, The Harper Collins Dictionary of Biology (1991). As used herein, the following terms have the meanings ascribed to them below, unless specified otherwise.

The present invention features one or more DsiRNA molecules that can modulate (e.g., inhibit) CKAP5 expression. The DsiRNAs of the invention optionally can be used in combination with modulators of other genes and/or gene products associated with the maintenance or development of diseases or disorders associated with CKAP5 misregulation (e.g., tumor formation and/or growth, etc.). The DsiRNA agents of the invention modulate CKAP5 RNAs such as those corresponding to the cDNA sequences referred to by GenBank Accession Nos. NM_001008938.3 (human CKAP5, transcript variant 1), NM_014756.3 (human CKAP5, transcript variant 2) and NM_001165989.1 (mouse CKAP5), which are referred to herein generally as "CKAP5."

The below description of the various aspects and embodiments of the invention is provided with reference to exemplary CKAP5 RNAs, generally referred to herein as CKAP5. However, such reference is meant to be exemplary only and the various aspects and embodiments of the invention are also directed to alternate CKAP5 RNAs, such as mutant CKAP5 RNAs or additional CKAP5 splice variants. Certain aspects and embodiments are also directed to other genes involved in CKAP5-related pathways, including genes whose misregulation acts in association with that of CKAP5 (or is affected or affects CKAP5 regulation) to produce phenotypic effects that may be targeted for treatment (e.g., tumor formation and/or growth, etc.). TACC1 is an example of a gene that interacts with CKAP5. Genes that interact with CKAP5, such as TACC1, and also components of those pathways that act in coordination with CKAP5, can be targeted using dsRNA and the methods described herein for use of CKAP5-targeting dsRNAs. Thus, the inhibition and the effects of such inhibition of the other genes can be performed as described herein.

The term "CKAP5" refers to nucleic acid sequences encoding a CKAP5 protein, peptide, or polypeptide (e.g., CKAP5 transcripts, such as the sequences of CKAP5 Genbank Accession Nos. NM_001008938.3, NM_014756.3 and NM_001165989.1). In certain embodiments, the term "CKAP5" is also meant to include other CKAP5 encoding sequence, such as other CKAP5 isoforms, mutant CKAP5 genes, splice variants of CKAP5 genes, and CKAP5 gene polymorphisms. The term "CKAP5" is also used to refer to the polypeptide gene product of a CKAP5 gene/transcript, e.g., a CKAP5 protein, peptide, or polypeptide, such as those encoded by CKAP5 Genbank Accession Nos. NP_001008938.1, NP_055571.2 and NP_001159461.1.

As used herein, a "CKAP5-associated disease or disorder" refers to a disease or disorder known in the art to be associated with altered CKAP5 expression, level and/or activity. Notably, a "CKAP5-associated disease or disorder" includes cancer and/or proliferative diseases, conditions, or disorders. Certain exemplary "CKAP5-associated disease or disorders" include liver cancer (e.g. hepatocellular carcinoma orHCC), lung cancer (e.g., NSCLC), colorectal cancer, prostate cancer, pancreatic cancer, ovarian cancer, cervical cancer, brain cancer (e.g., glioblastoma), renal cancer (e.g., papillary renal carcinoma), stomach cancer, esophageal cancer, medulloblasoma, thyroid carcinoma, rhabdomyosarcoma, osteosarcoma, squamous cell carcinoma (e.g., oral squamous cell carcinoma), melanoma, breast cancer, and hematopoietic disorders (e.g., leukemias and lymphomas, and other immune cell-related disorders). Other hyperproliferative diseases or disorders may also be targeted, including, e.g., bladder, cervical (uterine), endometrial (uterine), head and neck, and oropharyngeal cancers.

By "proliferative disease" or "cancer" as used herein is meant, a disease, condition, trait, genotype or phenotype characterized by unregulated cell growth or replication as is known in the art; including hepatocellular carcinoma (HCC), leukemias, for example, acute myelogenous leukemia (AML), chronic myelogenous leukemia (CML), acute lymphocytic leukemia (ALL), and chronic lymphocytic leukemia, AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphoma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adeno carcinoma, parotid adenocarcinoma, endometrial sarcoma, multidrug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and other cancer or proliferative disease, condition, trait, genotype or phenotype that can respond to the modulation of disease related gene expression in a cell or tissue, alone or in combination with other therapies.

In certain embodiments, dsRNA-mediated inhibition of a CKAP5 target sequence is assessed. In such embodiments, CKAP5 RNA levels can be assessed by art-recognized methods (e.g., RT-PCR, Northern blot, expression array, etc.), optionally via comparison of CKAP5 levels in the presence of an anti-CKAP5 dsRNA of the invention relative to the absence of such an anti-CKAP5 dsRNA. In certain embodiments, CKAP5 levels in the presence of an anti-CKAP5 dsRNA are compared to those observed in the presence of vehicle alone, in the presence of a dsRNA directed against an unrelated target RNA, or in the absence of any treatment.

It is also recognized that levels of CKAP5 protein can be assessed and that CKAP5 protein levels are, under different conditions, either directly or indirectly related to CKAP5 RNA levels and/or the extent to which a dsRNA inhibits CKAP5 expression, thus art-recognized methods of assessing CKAP5 protein levels (e.g., Western blot, immunoprecipitation, other antibody-based methods, etc.) can also be employed to examine the inhibitory effect of a dsRNA of the invention.

An anti-CKAP5 dsRNA of the invention is deemed to possess "CKAP5 inhibitory activity" if a statistically significant reduction in CKAP5 RNA (or when the CKAP5 protein is assessed, CKAP5 protein levels) is seen when an anti-CKAP5 dsRNA of the invention is administered to a system (e.g., cell-free in vitro system), cell, tissue or organism, as compared to a selected control. The distribution of experimental values and the number of replicate assays performed will tend to dictate the parameters of what levels of reduction in CKAP5 RNA (either as a % or in absolute terms) is deemed statistically significant (as assessed by standard methods of determining statistical significance known in the art). However, in certain embodiments, "CKAP5 inhibitory activity" is defined based upon a % or absolute level of reduction in the level of CKAP5 in a system, cell, tissue or organism. For example, in certain embodiments, a dsRNA of the invention is deemed to possess CKAP5 inhibitory activity if at least a 5% reduction or at least a 10% reduction in CKAP5 RNA is observed in the presence of a dsRNA of the invention relative to CKAP5 levels seen for a suitable control. (For example, in vivo CKAP5 levels in a tissue and/or subject can, in certain embodiments, be deemed to be inhibited by a dsRNA agent of the invention if, e.g., a 5% or 10% reduction in CKAP5 levels is observed relative to a control.) In certain other embodiments, a dsRNA of the invention is deemed to possess CKAP5 inhibitory activity if CKAP5 RNA levels are observed to be reduced by at least 15% relative to a selected control, by at least 20% relative to a selected control, by at least 25% relative to a selected control, by at least 30% relative to a selected control, by at least 35% relative to a selected control, by at least 40% relative to a selected control, by at least 45% relative to a selected control, by at least 50% relative to a selected control, by at least 55% relative to a selected control, by at least 60% relative to a selected control, by at least 65% relative to a selected control, by at least 70% relative to a selected control, by at least 75% relative to a selected control, by at least 80% relative to a selected control, by at least 85% relative to a selected control, by at least 90% relative to a selected control, by at least 95% relative to a selected control, by at least 96% relative to a selected control, by at least 97% relative to a selected control, by at least 98% relative to a selected control or by at least 99% relative to a selected control. In some embodiments, complete inhibition of CKAP5 is required for a dsRNA to be deemed to possess CKAP5 inhibitory activity. In certain models (e.g., cell culture), a dsRNA is deemed to possess CKAP5 inhibitory activity if at least a 50% reduction in CKAP5 levels is observed relative to a suitable control. In certain other embodiments, a dsRNA is deemed to possess CKAP5 inhibitory activity if at least an 80% reduction in CKAP5 levels is observed relative to a suitable control.

By way of specific example, in Example 2 below, a series of DsiRNAs targeting CKAP5 were tested for the ability to reduce CKAP5 mRNA levels in human HeLa cells in vitro, at 1 nM concentrations in the environment of such cells and in the presence of a transfection agent (Lipofectamine™ RNAiMAX, Invitrogen). Within Example 2 below, CKAP5 inhibitory activity was ascribed to those DsiRNAs that were observed to effect at least a 70% reduction of CKAP5 mRNA levels under the assayed conditions. It is contemplated that CKAP5 inhibitory activity could also be attributed to a dsRNA under either more or less stringent conditions than those employed for Example 2 below, even when the same or a similar assay and conditions are employed. For example, in certain embodiments, a tested dsRNA of the invention is deemed to possess CKAP5 inhibitory activity if at least a 10% reduction, at least a 20% reduction, at least a 30% reduction, at least a 40% reduction, at least a 50% reduction, at least a 60% reduction, at least a 75% reduction, at least an 80% reduction, at least an 85% reduction, at least a 90% reduction, or at least a 95% reduction in CKAP5 mRNA levels is observed in a mammalian cell line in vitro at 1 nM dsRNA concentration or lower in the environment of a cell, relative to a suitable control.

Use of other endpoints for determination of whether a double stranded RNA of the invention possesses CKAP5 inhibitory activity is also contemplated. Specifically, in one embodiment, in addition to or as an alternative to assessing CKAP5 mRNA levels, the ability of a tested dsRNA to reduce CKAP5 protein levels (e.g., at 48 hours after contacting a mammalian cell in vitro or in vivo) is assessed, and a tested dsRNA is deemed to possess CKAP5 inhibitory activity if at least a 10% reduction, at least a 20% reduction, at least a 30% reduction, at least a 40% reduction, at least a 50% reduction, at least a 60% reduction, at least a 70% reduction, at least a 75% reduction, at least an 80% reduction, at least an 85% reduction, at least a 90% reduction, or at least a 95% reduction in CKAP5 protein levels is observed in a mammalian cell contacted with the assayed double stranded RNA in vitro or in vivo, relative to a suitable control. Additional endpoints contemplated include, e.g., assessment of a phenotype associated with reduction of CKAP5 levels—e.g., reduction of growth of a contacted mammalian cell line in vitro and/or reduction of growth of a tumor in vivo, including, e.g., halting or reducing the growth of tumor or cancer cell levels as described in greater detail elsewhere herein.

CKAP5 inhibitory activity can also be evaluated over time (duration) and over concentration ranges (potency), with assessment of what constitutes a dsRNA possessing CKAP5 inhibitory activity adjusted in accordance with concentrations administered and duration of time following administration. Thus, in certain embodiments, a dsRNA of the invention is deemed to possess CKAP5 inhibitory activity if at least a 50% reduction in CKAP5 activity is observed/persists at a duration of time of 2 hours, 5 hours, 10 hours, 1 day, 2 days, 3 days, 4 days, 5 days, 6 days, 7 days, 8 days, 9 days, 10 days or more after administration of the dsRNA to a cell or organism. In additional embodiments, a dsRNA of the invention is deemed to be a potent CKAP5 inhibitory agent if CKAP5 inhibitory activity (e.g., in certain embodiments, at least 50% inhibition of CKAP5) is observed at a concentration of 1 nM or less, 500 pM or less, 200 pM or less, 100 pM or less, 50 pM or less, 20 pM or less, 10 pM or less, 5 pM or less, 2 pM or less or even 1 pM or less in the environment of a cell, for example, within an in vitro assay for CKAP5 inhibitory activity as described herein. In certain embodiments, a potent CKAP5 inhibitory dsRNA of the invention is defined as one that is capable of CKAP5 inhibitory activity (e.g., in certain embodiments, at least 20% reduction of CKAP5 levels) at a formulated concentration of 10 mg/kg or less when administered to a subject in an effective delivery vehicle (e.g., an effective lipid nanoparticle formulation). Preferably, a potent CKAP5 inhibitory dsRNA of the invention is defined as one that is capable of CKAP5 inhibitory activity (e.g., in certain embodiments, at least 50% reduction of CKAP5 levels) at a formulated concentration of 5 mg/kg or less when administered to a subject in an effective delivery vehicle. More preferably, a potent CKAP5 inhibitory dsRNA of the invention is defined as one that is capable of CKAP5 inhibitory activity (e.g., in certain embodiments, at least 50% reduction of CKAP5 levels) at a formulated concentration of 5 mg/kg or less when administered to a subject in an effective delivery vehicle. Optionally, a potent CKAP5 inhibitory dsRNA of the invention is defined as one that is capable of CKAP5 inhibitory activity (e.g., in certain embodiments, at least 50% reduction of CKAP5 levels) at a formulated concentration of 2 mg/kg or less, or even 1 mg/kg or less, when administered to a subject in an effective delivery vehicle.

In certain embodiments, potency of a dsRNA of the invention is determined in reference to the number of copies of a dsRNA present in the cytoplasm of a target cell that are required to achieve a certain level of target gene knockdown. For example, in certain embodiments, a potent dsRNA is one capable of causing 50% or greater knockdown of a target mRNA when present in the cytoplasm of a target cell at a copy number of 1000 or fewer RISC-loaded antisense strands per cell. More preferably, a potent dsRNA is one capable of producing 50% or greater knockdown of a target mRNA when present in the cytoplasm of a target cell at a copy number of 500 or fewer RISC-loaded antisense strands per cell. Optionally, a potent dsRNA is one capable of producing 50% or greater knockdown of a target mRNA when present in the cytoplasm of a target cell at a copy number of 300 or fewer RISC-loaded antisense strands per cell.

In further embodiments, the potency of a DsiRNA of the invention can be defined in reference to a 19 to 23mer dsRNA directed to the same target sequence within the same target gene. For example, a DsiRNA of the invention that possesses enhanced potency relative to a corresponding 19 to 23mer dsRNA can be a DsiRNA that reduces a target gene by an additional 5% or more, an additional 10% or more, an additional 20% or more, an additional 30% or more, an additional 40% or more, or an additional 50% or more as compared to a corresponding 19 to 23mer dsRNA, when assayed in an in vitro assay as described herein at a sufficiently low concentration to allow for detection of a potency difference (e.g., transfection concentrations at or below 1 nM in the environment of a cell, at or below 100 pM in the environment of a cell, at or below 10 pM in the environment of a cell, at or below 1 nM in the environment of a cell, in an in vitro assay as described herein; notably, it is recognized that potency differences can be best detected via performance of such assays across a range of concentrations—e.g., 0.1 pM to 10 nM—for purpose of generating a dose-response curve and identifying an $IC_{50}$ value associated with a DsiRNA/dsRNA).

CKAP5 inhibitory levels and/or CKAP5 levels may also be assessed indirectly, e.g., measurement of a reduction of the size, number and/or rate of growth or spread of polyps or tumors in a subject may be used to assess CKAP5 levels and/or CKAP5 inhibitory efficacy of a double-stranded nucleic acid of the instant invention.

In certain embodiments, the phrase "consists essentially of" is used in reference to the anti-CKAP5 dsRNAs of the invention. In some such embodiments, "consists essentially of" refers to a composition that comprises a dsRNA of the invention which possesses at least a certain level of CKAP5 inhibitory activity (e.g., at least 50% CKAP5 inhibitory activity) and that also comprises one or more additional components and/or modifications that do not significantly impact the CKAP5 inhibitory activity of the dsRNA. For example, in certain embodiments, a composition "consists essentially of" a dsRNA of the invention where modifications of the dsRNA of the invention and/or dsRNA-associated components of the composition do not alter the CKAP5 inhibitory activity (optionally including potency or duration of CKAP5 inhibitory activity) by greater than 3%, greater than 5%, greater than 10%, greater than 15%, greater than 20%, greater than 25%, greater than 30%, greater than 35%, greater than 40%, greater than 45%, or greater than 50% relative to the dsRNA of the invention in isolation. In certain embodiments, a composition is deemed to consist essentially of a dsRNA of the invention even if more dramatic reduction of CKAP5 inhibitory activity (e.g., 80% reduction, 90% reduction, etc. in efficacy, duration and/or potency) occurs in the presence of additional components or modifications, yet where CKAP5 inhibitory activity is not significantly elevated (e.g., observed levels of CKAP5 inhibitory activity are within 10% those observed for the isolated dsRNA of the invention) in the presence of additional components and/or modifications.

As used herein, the term "nucleic acid" refers to deoxyribonucleotides, ribonucleotides, or modified nucleotides, and polymers thereof in single- or double-stranded form. The term encompasses nucleic acids containing known nucleotide analogs or modified backbone residues or linkages, which are synthetic, naturally occurring, and non-naturally occurring, which have similar binding properties as the reference nucleic acid, and which are metabolized in a manner similar to the reference nucleotides. Examples of such analogs include, without limitation, phosphorothioates, phosphoramidates, methyl phosphonates, chiral-methyl phosphonates, 2-O-methyl ribonucleotides, peptide-nucleic acids (PNAs) and unlocked nucleic acids (UNAs; see, e.g., Jensen et al. *Nucleic Acids Symposium Series* 52: 133-4), and derivatives thereof.

As used herein, "nucleotide" is used as recognized in the art to include those with natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, e.g., Usman and McSwiggen, supra; Eckstein, et al., International PCT Publication No. WO 92/07065; Usman et al, International PCT Publication No. WO 93/15187; Uhlman & Peyman, supra, all are hereby incorporated by reference herein). There are several examples of modified nucleic acid bases known in the art as summarized by Limbach, et al, *Nucleic Acids Res.* 22:2183, 1994. Some of the non-limiting examples of base modifications that can be introduced into nucleic acid molecules include, hypoxanthine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin, et al., Biochemistry 35:14090, 1996; Uhlman & Peyman, supra). By "modified bases" in this aspect is meant nucleotide bases other than adenine, guanine, cytosine and uracil at 1' position or their equivalents.

As used herein, "modified nucleotide" refers to a nucleotide that has one or more modifications to the nucleoside, the nucleobase, pentose ring, or phosphate group. For example, modified nucleotides exclude ribonucleotides containing adenosine monophosphate, guanosine monophosphate, uridine monophosphate, and cytidine monophosphate and deoxyribonucleotides containing deoxyadenosine monophosphate, deoxyguanosine monophosphate, deoxythymidine monophosphate, and deoxycytidine monophosphate. Modifications include those naturally occurring that result from modification by enzymes that modify nucleotides, such as methyltransferases. Modified nucleotides also include synthetic or non-naturally occurring nucleotides. Synthetic or non-naturally occurring modifications in nucleotides include those with 2' modifications, e.g., 2'-methoxyethoxy, 2'-fluoro, 2'-allyl, 2'-O-[2-(methylamino)-2-oxoethyl], 4'-thio, 4'-CH₂—O-2'-bridge, 4'-(CH₂)₂—O-2'-bridge, 2'-LNA or other bicyclic or "bridged" nucleoside analog, and 2'-O—(N-methylcarbamate) or those comprising base analogs. In connection with 2'-modified nucleotides as described for the present disclosure, by "amino" is meant 2'-NH₂ or 2'-O—NH₂, which can be modified or unmodified. Such modified groups are described, e.g., in Eckstein et al., U.S. Pat. No. 5,672,695 and Matulic-Adamic et al., U.S. Pat. No. 6,248,878. "Modified nucleotides" of the instant invention can also include nucleotide analogs as described above.

In reference to the nucleic acid molecules of the present disclosure, modifications may exist upon these agents in patterns on one or both strands of the double stranded ribonucleic acid (dsRNA). As used herein, "alternating positions" refers to a pattern where every other nucleotide is a modified nucleotide or there is an unmodified nucleotide (e.g., an unmodified ribonucleotide) between every modified nucleotide over a defined length of a strand of the dsRNA (e.g., 5'-MNMNMN-3'; 3'-MNMNMN-5'; where M is a modified nucleotide and N is an unmodified nucleotide). The modification pattern starts from the first nucleotide position at either the 5' or 3' terminus according to a position numbering convention, e.g., as described herein (in certain embodiments, position 1 is designated in reference to the terminal residue of a strand following a projected Dicer cleavage event of a DsiRNA agent of the invention; thus, position 1 does not always constitute a 3' terminal or 5' terminal residue of a pre-processed agent of the invention). The pattern of modified nucleotides at alternating positions may run the full length of the strand, but in certain embodiments includes at least 4, 6, 8, 10, 12, 14 nucleotides containing at least 2, 3, 4, 5, 6 or 7 modified nucleotides, respectively. As used herein, "alternating pairs of positions" refers to a pattern where two consecutive modified nucleotides are separated by two consecutive unmodified nucleotides over a defined length of a strand of the dsRNA (e.g., 5'-MMNNMMNNMMNN-3'; 3'-MMNNMMNNMMNN-5'; where M is a modified nucleotide and N is an unmodified nucleotide). The modification pattern starts from the first nucleotide position at either the 5' or 3' terminus according to a position numbering convention such as those described herein. The pattern of modified nucleotides at alternating positions may run the full length of the strand, but preferably includes at least 8, 12, 16, 20, 24, 28 nucleotides containing at least 4, 6, 8, 10, 12 or 14 modified nucleotides, respectively. It is emphasized that the above modification patterns are exemplary and are not intended as limitations on the scope of the invention.

As used herein, "base analog" refers to a heterocyclic moiety which is located at the 1' position of a nucleotide sugar moiety in a modified nucleotide that can be incorporated into a nucleic acid duplex (or the equivalent position in a nucleotide sugar moiety substitution that can be incorporated into a nucleic acid duplex). In the dsRNAs of the invention, a base analog is generally either a purine or pyrimidine base excluding the common bases guanine (G), cytosine (C), adenine (A), thymine (T), and uracil (U). Base analogs can duplex with other bases or base analogs in dsRNAs. Base analogs include those useful in the compounds and methods of the invention, e.g., those disclosed in U.S. Pat. Nos. 5,432,272 and 6,001,983 to Benner and US Patent Publication No. 20080213891 to Manoharan, which are herein incorporated by reference. Non-limiting examples of bases include hypoxanthine (I), xanthine (X), 3β-D-ribofuranosyl-(2,6-diaminopyrimidine) (K), 3-β-D-ribofuranosyl-(1-methyl-pyrazolo[4,3-d]pyrimidine-5,7(4H,6H)-dione) (P), iso-cytosine (iso-C), iso-guanine (iso-G), 1-β-D-ribofuranosyl-(5-nitroindole), 1-β-D-ribofuranosyl-(3-nitropyrrole), 5-bromouracil, 2-aminopurine, 4-thio-dT, 7-(2-thienyl)-imidazo[4,5-b]pyridine (Ds) and pyrrole-2-carbaldehyde (Pa), 2-amino-6-(2-thienyl)purine (S), 2-oxopyridine (Y), difluorotolyl, 4-fluoro-6-methylbenzimidazole, 4-methylbenzimidazole, 3-methyl isocarbostyrilyl, 5-methyl isocarbostyrilyl, and 3-methyl-7-propynyl isocarbostyrilyl, 7-azaindolyl, 6-methyl-7-azaindolyl, imidizopyridinyl, 9-methyl-imidizopyridinyl, pyrrolopyrizinyl, isocarbostyrilyl, 7-propynyl isocarbostyrilyl, propynyl-7-azaindolyl, 2,4,5-trimethylphenyl, 4-methylindolyl, 4,6-dimethylindolyl, phenyl, napthalenyl, anthracenyl, phenanthracenyl, pyrenyl, stilbenzyl, tetracenyl, pentacenyl, and structural derivates thereof (Schweitzer et al., J. Org. Chem., 59:7238-7242 (1994); Berger et al., Nucleic Acids Research, 28(15):2911-2914 (2000); Moran et al., J. Am. Chem. Soc., 119:2056-2057 (1997); Morales et al., J. Am. Chem. Soc., 121:2323-2324 (1999); Guckian et al., J. Am. Chem. Soc., 118:8182-8183 (1996); Morales et al., J. Am. Chem. Soc., 122(6):1001-1007 (2000); McMinn et al., J. Am. Chem. Soc., 121:11585-11586 (1999); Guckian et al., J. Org. Chem., 63:9652-9656 (1998); Moran et al., Proc. Natl. Acad. Sci., 94:10506-10511 (1997); Das et al., J. Chem. Soc., Perkin Trans., 1:197-206 (2002); Shibata et al., J. Chem. Soc., Perkin Trans., 1: 1605-1611 (2001); Wu et al., J. Am. Chem. Soc., 122(32):7621-7632 (2000); O'Neill et al., J. Org. Chem., 67:5869-5875 (2002); Chaudhuri et al., J. Am. Chem. Soc., 117:10434-10442 (1995); and U.S. Pat. No. 6,218,108). Base analogs may also be a universal base.

As used herein, "universal base" refers to a heterocyclic moiety located at the 1' position of a nucleotide sugar moiety in a modified nucleotide, or the equivalent position in a nucleotide sugar moiety substitution, that, when present in a nucleic acid duplex, can be positioned opposite more than one type of base without altering the double helical structure (e.g., the structure of the phosphate backbone). Additionally, the universal base does not destroy the ability of the single stranded nucleic acid in which it resides to duplex to a target nucleic acid. The ability of a single stranded nucleic acid containing a universal base to duplex a target nucleic can be assayed by methods apparent to one in the art (e.g., UV absorbance, circular dichroism, gel shift, single stranded nuclease sensitivity, etc.). Additionally, conditions under which duplex formation is observed may be varied to determine duplex stability or formation, e.g., temperature, as melting temperature (Tm) correlates with the stability of nucleic acid duplexes. Compared to a reference single stranded nucleic acid that is exactly complementary to a target nucleic acid, the single stranded nucleic acid containing a universal base forms a duplex with the target nucleic acid that has a lower Tm than a duplex formed with the complementary nucleic acid. However, compared to a reference single stranded nucleic acid in which the universal base has been replaced with a base to generate a single mismatch, the single stranded nucleic acid containing the universal base forms a duplex with the target nucleic acid that has a higher Tm than a duplex formed with the nucleic acid having the mismatched base.

Some universal bases are capable of base pairing by forming hydrogen bonds between the universal base and all of the bases guanine (G), cytosine (C), adenine (A), thymine (T), and uracil (U) under base pair forming conditions. A universal base is not a base that forms a base pair with only one single complementary base. In a duplex, a universal base may form no hydrogen bonds, one hydrogen bond, or more than one hydrogen bond with each of G, C, A, T, and U opposite to it on the opposite strand of a duplex. Preferably, the universal bases does not interact with the base opposite to it on the opposite strand of a duplex. In a duplex, base pairing between a universal base occurs without altering the double helical structure of the phosphate backbone. A universal base may also interact with bases in adjacent nucleotides on the same nucleic acid strand by stacking interactions. Such stacking interactions stabilize the duplex, especially in situations where the universal base does not form any hydrogen bonds with the base positioned opposite to it on the opposite strand of the duplex. Non-limiting examples of universal-binding nucleotides include inosine, 1-β-D-ribofuranosyl-5-nitroindole, and/or 1-β-D-ribofuranosyl-3-nitropyrrole (US Pat. Appl. Publ. No. 20070254362 to Quay et al.; Van Aerschot et al., An acyclic 5-nitroindazole nucleoside analogue as ambiguous nucleoside. Nucleic Acids Res. 1995 Nov. 11; 23(21):4363-70; Loakes et al., 3-Nitropyrrole and 5-nitroindole as universal bases in primers for DNA sequencing and PCR. Nucleic Acids Res. 1995 Jul. 11; 23(13):2361-6; Loakes and Brown, 5-Nitroindole as an universal base analogue. Nucleic Acids Res. 1994 Oct. 11; 22(20):4039-43).

As used herein, "loop" refers to a structure formed by a single strand of a nucleic acid, in which complementary regions that flank a particular single stranded nucleotide region hybridize in a way that the single stranded nucleotide region between the complementary regions is excluded from duplex formation or Watson-Crick base pairing. A loop is a single stranded nucleotide region of any length. Examples of loops include the unpaired nucleotides present in such structures as hairpins, stem loops, or extended loops.

As used herein, "extended loop" in the context of a dsRNA refers to a single stranded loop and in addition 1, 2, 3, 4, 5, 6 or up to 20 base pairs or duplexes flanking the loop. In an extended loop, nucleotides that flank the loop on the 5' side form a duplex with nucleotides that flank the loop on the 3' side. An extended loop may form a hairpin or stem loop.

As used herein, "tetraloop" in the context of a dsRNA refers to a loop (a single stranded region) consisting of four nucleotides that forms a stable secondary structure that contributes to the stability of an adjacent Watson-Crick hybridized nucleotides. Without being limited to theory, a tetraloop may stabilize an adjacent Watson-Crick base pair by stacking interactions. In addition, interactions among the four nucleotides in a tetraloop include but are not limited to non-Watson-Crick base pairing, stacking interactions, hydrogen bonding, and contact interactions (Cheong et al., *Nature* 1990 Aug. 16; 346(6285):680-2; Heus and Pardi, *Science* 1991 Jul. 12; 253(5016):191-4). A tetraloop confers an increase in the melting temperature (Tm) of an adjacent duplex that is higher than expected from a simple model loop sequence consisting of four random bases. For example, a tetraloop can confer a melting temperature of at least 55° C. in 10 mM NaHPO$_4$ to a hairpin comprising a duplex of at least 2 base pairs in length. A tetraloop may contain ribonucleotides, deoxyribonucleotides, modified nucleotides, and combinations thereof. Examples of RNA tetraloops include the UNCG family of tetraloops (e.g., UUCG), the GNRA family of tetraloops (e.g., GAAA), and the CUUG tetraloop. (Woese et al., *Proc Natl Acad Sci USA*. 1990 November; 87(21):8467-71; Antao et al., *Nucleic Acids Res*. 1991 Nov. 11; 19(21):5901-5). Examples of DNA tetraloops include the d(GNNA) family of tetraloops (e.g., d(GTTA), the d(GNRA)) family of tetraloops, the d(GNAB) family of tetraloops, the d(CNNG) family of tetraloops, the d(TNCG) family of tetraloops (e.g., d(TTCG)). (Nakano et al. Biochemistry, 41 (48), 14281-14292, 2002; SHINJI et al. Nippon Kagakkai Koen Yokoshu VOL. 78th; NO. 2; PAGE. 731 (2000).)

As used herein, the term "siRNA" refers to a double stranded nucleic acid in which each strand comprises RNA, RNA analog(s) or RNA and DNA. The siRNA comprises between 19 and 23 nucleotides or comprises 21 nucleotides. The siRNA typically has 2 bp overhangs on the 3' ends of each strand such that the duplex region in the siRNA comprises 17-21 nucleotides, or 19 nucleotides. Typically, the antisense strand of the siRNA is sufficiently complementary with the target sequence of the CKAP5 gene/RNA.

An anti-CKAP5 DsiRNA of the instant invention possesses strand lengths of at least 25 nucleotides. Accordingly, in certain embodiments, an anti-CKAP5 DsiRNA contains one oligonucleotide sequence, a first sequence, that is at least 25 nucleotides in length and no longer than 35 or up to 50 or more nucleotides. This sequence of RNA can be between 26 and 35, 26 and 34, 26 and 33, 26 and 32, 26 and 31, 26 and 30, and 26 and 29 nucleotides in length. This sequence can be 27 or 28 nucleotides in length or 27 nucleotides in length. The second sequence of the DsiRNA agent can be a sequence that anneals to the first sequence under biological conditions, such as within the cytoplasm of a eukaryotic cell. Generally, the second oligonucleotide sequence will have at least 19 complementary base pairs with the first oligonucleotide sequence, more typically the second oligonucleotide sequence will have 21 or more complementary base pairs, or 25 or more complementary base pairs with the first oligonucleotide sequence. In one embodiment, the second sequence is the same length as the first sequence, and the DsiRNA agent is blunt ended. In another embodiment, the ends of the DsiRNA agent have one or more overhangs.

In certain embodiments, the first and second oligonucleotide sequences of the DsiRNA agent exist on separate oligonucleotide strands that can be and typically are chemically synthesized. In some embodiments, both strands are between 26 and 35 nucleotides in length. In other embodiments, both strands are between 25 and 30 or 26 and 30 nucleotides in length. In one embodiment, both strands are 27 nucleotides in length, are completely complementary and have blunt ends. In certain embodiments of the instant invention, the first and second sequences of an anti-CKAP5 DsiRNA exist on separate RNA oligonucleotides (strands). In one embodiment, one or both oligonucleotide strands are capable of serving as a substrate for Dicer. In other embodiments, at least one modification is present that promotes Dicer to bind to the double-stranded RNA structure in an orientation that maximizes the double-stranded RNA structure's effectiveness in inhibiting gene expression. In certain embodiments of the instant invention, the anti-CKAP5 DsiRNA agent is comprised of two oligonucleotide strands of differing lengths, with the anti-CKAP5 DsiRNA possessing a blunt end at the 3' terminus of a first strand (sense strand) and a 3' overhang at the 3' terminus of a second strand (antisense strand). The DsiRNA can also contain one or more deoxyribonucleic acid (DNA) base substitutions.

Suitable DsiRNA compositions that contain two separate oligonucleotides can be chemically linked outside their annealing region by chemical linking groups. Many suitable chemical linking groups are known in the art and can be used. Suitable groups will not block Dicer activity on the DsiRNA and will not interfere with the directed destruction of the RNA transcribed from the target gene. Alternatively, the two separate oligonucleotides can be linked by a third oligonucleotide such that a hairpin structure is produced upon annealing of the two oligonucleotides making up the DsiRNA composition. The hairpin structure will not block Dicer activity on the DsiRNA and will not interfere with the directed destruction of the target RNA.

As used herein, a dsRNA, e.g., DsiRNA or siRNA, having a sequence "sufficiently complementary" to a target RNA or cDNA sequence (e.g., CKAP5 mRNA) means that the dsRNA has a sequence sufficient to trigger the destruction of the target RNA (where a cDNA sequence is recited, the RNA sequence corresponding to the recited cDNA sequence) by the RNAi machinery (e.g., the RISC complex) or process. For example, a dsRNA that is "sufficiently complementary" to a target RNA or cDNA sequence to trigger the destruction of the target RNA by the RNAi machinery or process can be identified as a dsRNA that causes a detectable reduction in the level of the target RNA in an appropriate assay of dsRNA activity (e.g., an in vitro assay as described in Example 2 below), or, in further examples, a dsRNA that is sufficiently complementary to a target RNA or cDNA sequence to trigger the destruction of the target RNA by the RNAi machinery or process can be identified as a dsRNA that produces at least a 5%, at least a 10%, at least a 15%, at least a 20%, at least a 25%, at least a 30%, at least a 35%, at least a 40%, at least a 45%, at least a 50%, at least a 55%, at least a 60%, at least a 65%, at least a 70%, at least a 75%, at least a 80%, at least a 85%, at least a 90%, at least a 95%, at least a 98% or at least a 99% reduction in the level of the target RNA in an appropriate assay of dsRNA activity. In additional examples, a dsRNA that is sufficiently complementary to a target RNA or cDNA sequence to trigger the destruction of the target RNA by the RNAi machinery or process can be identified based upon assessment of the duration of a certain level of inhibitory activity with respect to the target RNA or protein levels in a cell or organism. For example, a dsRNA that is sufficiently complementary to a target RNA or cDNA sequence to trigger the destruction of the target RNA by the RNAi machinery or process can be identified as a dsRNA capable of reducing target mRNA levels by at least 20% at least 48 hours post-administration of said dsRNA to a cell or organism. Preferably, a dsRNA that is sufficiently complementary to a target RNA or cDNA sequence to trigger the destruction of the target RNA by the RNAi machinery or process is identified as a dsRNA capable of reducing target mRNA levels by at least 40% at least 72 hours post-administration of said dsRNA to a cell or organism, by at least 40% at least four, five or seven days post-administration of said dsRNA to a cell or organism, by at least 50% at least 48 hours post-administration of said dsRNA to a cell or organism, by at least 50% at least 72 hours post-administration of said dsRNA to a cell or organism, by at least 50% at least four, five or seven days post-administration of said dsRNA to a cell or organism, by at least 80% at least 48 hours post-administration of said dsRNA to a cell or organism, by at least 80% at least 72 hours post-administration of said dsRNA to a cell or organism, or by at least 80% at least four, five or seven days post-administration of said dsRNA to a cell or organism.

The dsRNA molecule can be designed such that every residue of the antisense strand is complementary to a residue in the target molecule. Alternatively, substitutions can be made within the molecule to increase stability and/or enhance processing activity of said molecule. Substitutions can be made within the strand or can be made to residues at the ends of the strand. In certain embodiments, substitutions and/or modifications are made at specific residues within a DsiRNA agent. Such substitutions and/or modifications can include, e.g., deoxy-modifications at one or more residues of positions 1, 2 and 3 when numbering from the 3' terminal position of the sense strand of a DsiRNA agent; and introduction of 2'-O-alkyl (e.g., 2'-O-methyl) modifications at the 3' terminal residue of the antisense strand of DsiRNA agents, with such modifications also being performed at overhang positions of the 3' portion of the antisense strand and at alternating residues of the antisense strand of the DsiRNA that are included within the region of a DsiRNA agent that is processed to form an active siRNA agent. The preceding modifications are offered as exemplary, and are not intended to be limiting in any manner. Further consideration of the structure of preferred DsiRNA agents, including further description of the modifications and substitutions that can be performed upon the anti-CKAP5 DsiRNA agents of the instant invention, can be found below.

Where a first sequence is referred to as "substantially complementary" with respect to a second sequence herein, the two sequences can be fully complementary, or they may form one or more, but generally not more than 4, 3 or 2 mismatched base pairs upon hybridization, while retaining the ability to hybridize under the conditions most relevant to their ultimate application. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, may yet be referred to as "fully complementary" for the purposes of the invention.

The term "double-stranded RNA" or "dsRNA", as used herein, refers to a complex of ribonucleic acid molecules, having a duplex structure comprising two anti-parallel and substantially complementary, as defined above, nucleic acid strands. The two strands forming the duplex structure may be different portions of one larger RNA molecule, or they may be separate RNA molecules. Where separate RNA molecules, such dsRNA are often referred to as siRNA ("short interfering RNA") or DsiRNA ("Dicer substrate siRNAs"). Where the two strands are part of one larger molecule, and therefore are connected by an uninterrupted chain of nucleotides between the 3'-end of one strand and the 5' end of the respective other strand forming the duplex structure, the connecting RNA chain is referred to as a "hairpin loop", "short hairpin RNA" or "shRNA". Where the two strands are connected covalently by means other than an uninterrupted chain of nucleotides between the 3'-end of one strand and the 5'end of the respective other strand forming the duplex structure, the connecting structure is referred to as a "linker". The RNA strands may have the same or a different number of nucleotides. The maximum number of base pairs is the number of nucleotides in the shortest strand of the dsRNA minus any overhangs that are present in the duplex. In addition to the duplex structure, a dsRNA may comprise one or more nucleotide overhangs. In addition, as used herein, "dsRNA" may include chemical modifications to ribonucleotides, internucleoside linkages, end-groups, caps, and conjugated moieties, including substantial modifications at multiple nucleotides and including all types of modifications disclosed herein or known in the art. Any such modifications, as used in an siRNA- or DsiRNA-type molecule, are encompassed by "dsRNA" for the purposes of this specification and claims.

The phrase "duplex region" refers to the region in two complementary or substantially complementary oligonucleotides that form base pairs with one another, either by Watson-Crick base pairing or other manner that allows for a duplex between oligonucleotide strands that are complementary or substantially complementary. For example, an oligonucleotide strand having 21 nucleotide units can base pair with another oligonucleotide of 21 nucleotide units, yet only 19 bases on each strand are complementary or substantially complementary, such that the "duplex region" consists of 19 base pairs. The remaining base pairs may, for example, exist as 5' and 3' overhangs. Further, within the duplex region, 100% complementarity is not required; substantial complementarity is allowable within a duplex region. Substantial complementarity refers to complementarity between the strands such that they are capable of annealing under biological conditions. Techniques to empirically determine if two strands are capable of annealing under biological conditions are well know in the art. Alternatively, two strands can be synthesized and added together under biological conditions to determine if they anneal to one another.

Single-stranded nucleic acids that base pair over a number of bases are said to "hybridize." Hybridization is typically determined under physiological or biologically relevant conditions (e.g., intracellular: pH 7.2, 140 mM potassium ion; extracellular pH 7.4, 145 mM sodium ion). Hybridization conditions generally contain a monovalent cation and biologically acceptable buffer and may or may not contain a divalent cation, complex anions, e.g. gluconate from potassium gluconate, uncharged species such as sucrose, and inert polymers to reduce the activity of water in the sample, e.g. PEG. Such conditions include conditions under which base pairs can form.

Hybridization is measured by the temperature required to dissociate single stranded nucleic acids forming a duplex, i.e., (the melting temperature; Tm). Hybridization conditions are also conditions under which base pairs can form. Various conditions of stringency can be used to determine hybridization (see, e.g., Wahl, G. M. and S. L. Berger (1987) Methods Enzymol. 152:399; Kimmel, A. R. (1987) Methods Enzymol. 152:507). Stringent temperature conditions will ordinarily include temperatures of at least about 30° C., more preferably of at least about 37° C., and most preferably of at least about 42° C. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). For example, a hybridization determination buffer is shown in Table 1.

TABLE 1

| | final conc. | Vender | Cat# | Lot# | m.w./Stock | To make 50 mL solution |
|---|---|---|---|---|---|---|
| NaCl | 100 mM | Sigma | S-5150 | 41K8934 | 5M | 1 mL |
| KCl | 80 mM | Sigma | P-9541 | 70K0002 | 74.55 | 0.298 g |
| MgCl$_2$ | 8 mM | Sigma | M-1028 | 120K8933 | 1M | 0.4 mL |
| sucrose | 2% w/v | Fisher | BP220-212 | 907105 | 342.3 | 1 g |
| Tris-HCl | 16 mM | Fisher | BP1757-500 | 12419 | 1M | 0.8 mL |
| NaH$_2$PO$_4$ | 1 mM | Sigma | S-3193 | 52H-029515 | 120.0 | 0.006 g |
| EDTA | 0.02 mM | Sigma | E-7889 | 110K89271 | 0.5M | 2 μL |
| H$_2$O | | Sigma | W-4502 | 51K2359 | | to 50 mL |
| pH = 7.0 at 20° C. | | | | adjust with HCl | | |

Useful variations on hybridization conditions will be readily apparent to those skilled in the art. Hybridization techniques are well known to those skilled in the art and are described, for example, in Benton and Davis (Science 196: 180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Antisense to Molecular Cloning Techniques, 1987, Academic Press, New York); and Sambrook et al., Molecular Cloning: A Laboratory Manual, Cold Spring Harbor Laboratory Press, New York.

As used herein, "oligonucleotide strand" is a single stranded nucleic acid molecule. An oligonucleotide may comprise ribonucleotides, deoxyribonucleotides, modified nucleotides (e.g., nucleotides with 2' modifications, synthetic base analogs, etc.) or combinations thereof. Such modified oligonucleotides can be preferred over native forms because of properties such as, for example, enhanced cellular uptake and increased stability in the presence of nucleases.

As used herein, the term "ribonucleotide" encompasses natural and synthetic, unmodified and modified ribonucleotides. Modifications include changes to the sugar moiety, to the base moiety and/or to the linkages between ribonucleotides in the oligonucleotide. As used herein, the term "ribonucleotide" specifically excludes a deoxyribonucleotide, which is a nucleotide possessing a single proton group at the 2' ribose ring position.

As used herein, the term "deoxyribonucleotide" encompasses natural and synthetic, unmodified and modified deoxyribonucleotides. Modifications include changes to the sugar moiety, to the base moiety and/or to the linkages between deoxyribonucleotide in the oligonucleotide. As used herein, the term "deoxyribonucleotide" also includes a modified ribonucleotide that does not permit Dicer cleavage of a dsRNA agent, e.g., a 2'-O-methyl ribonucleotide, a phosphorothioate-modified ribonucleotide residue, etc., that does not permit Dicer cleavage to occur at a bond of such a residue.

As used herein, the term "PS-NA" refers to a phosphorothioate-modified nucleotide residue. The term "PS-NA" therefore encompasses both phosphorothioate-modified ribonucleotides ("PS-RNAs") and phosphorothioate-modified deoxyribonucleotides ("PS-DNAs").

As used herein, "Dicer" refers to an endoribonuclease in the RNase III family that cleaves a dsRNA or dsRNA-containing molecule, e.g., double-stranded RNA (dsRNA) or pre-microRNA (miRNA), into double-stranded nucleic acid fragments 19-25 nucleotides long, usually with a two-base overhang on the 3' end. With respect to certain dsRNAs of the invention (e.g., "DsiRNAs"), the duplex formed by a dsRNA region of an agent of the invention is recognized by Dicer and is a Dicer substrate on at least one strand of the duplex. Dicer catalyzes the first step in the RNA interference pathway, which consequently results in the degradation of a target RNA. The protein sequence of human Dicer is provided at the NCBI database under accession number NP_085124, hereby incorporated by reference.

Dicer "cleavage" can be determined as follows (e.g., see Collingwood et al., Oligonucleotides 18:187-200 (2008)). In a Dicer cleavage assay, RNA duplexes (100 pmol) are incubated in 20 μL of 20 mM Tris pH 8.0, 200 mM NaCl, 2.5 mM MgCl2 with or without 1 unit of recombinant human Dicer (Stratagene, La Jolla, Calif.) at 37° C. for 18-24 hours. Samples are desalted using a Performa SR 96-well plate (Edge Biosystems, Gaithersburg, Md.). Electrospray-ionization liquid chromatography mass spectroscopy (ESI-LCMS) of duplex RNAs pre- and post-treatment with Dicer is done using an Oligo HTCS system (Novatia, Princeton, N.J.; Hail et al., 2004), which consists of a ThermoFinnigan TSQ7000, Xcalibur data system, ProMass data processing software and Paradigm MS4 HPLC (Michrom BioResources, Auburn, Calif.). In this assay, Dicer cleavage occurs where at least 5%, 10%, 20%, 30%, 40%, 50%, 60%, 70%, 80%, 90%, 95%, or even 100% of the Dicer substrate dsRNA, (i.e., 25-30 bp, dsRNA, preferably 26-30 bp dsRNA) is cleaved to a shorter dsRNA (e.g., 19-23 bp dsRNA, preferably, 21-23 bp dsRNA).

Figures 1, 4:
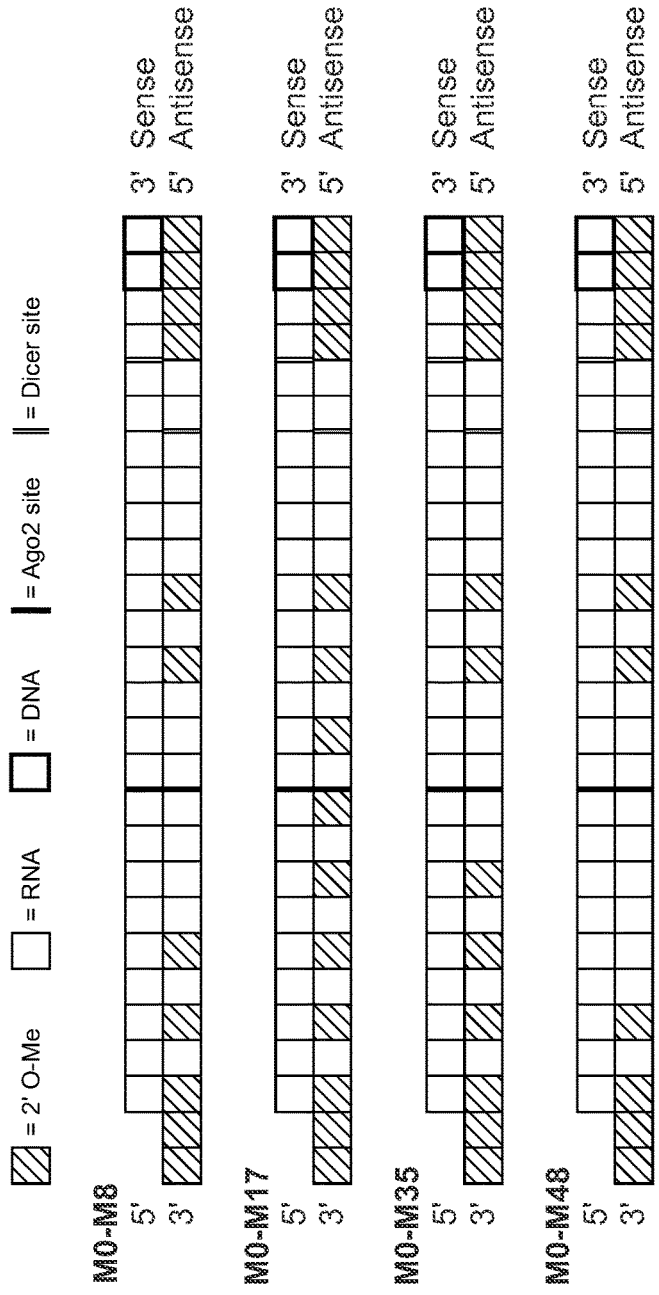
Figures 2A, 4:
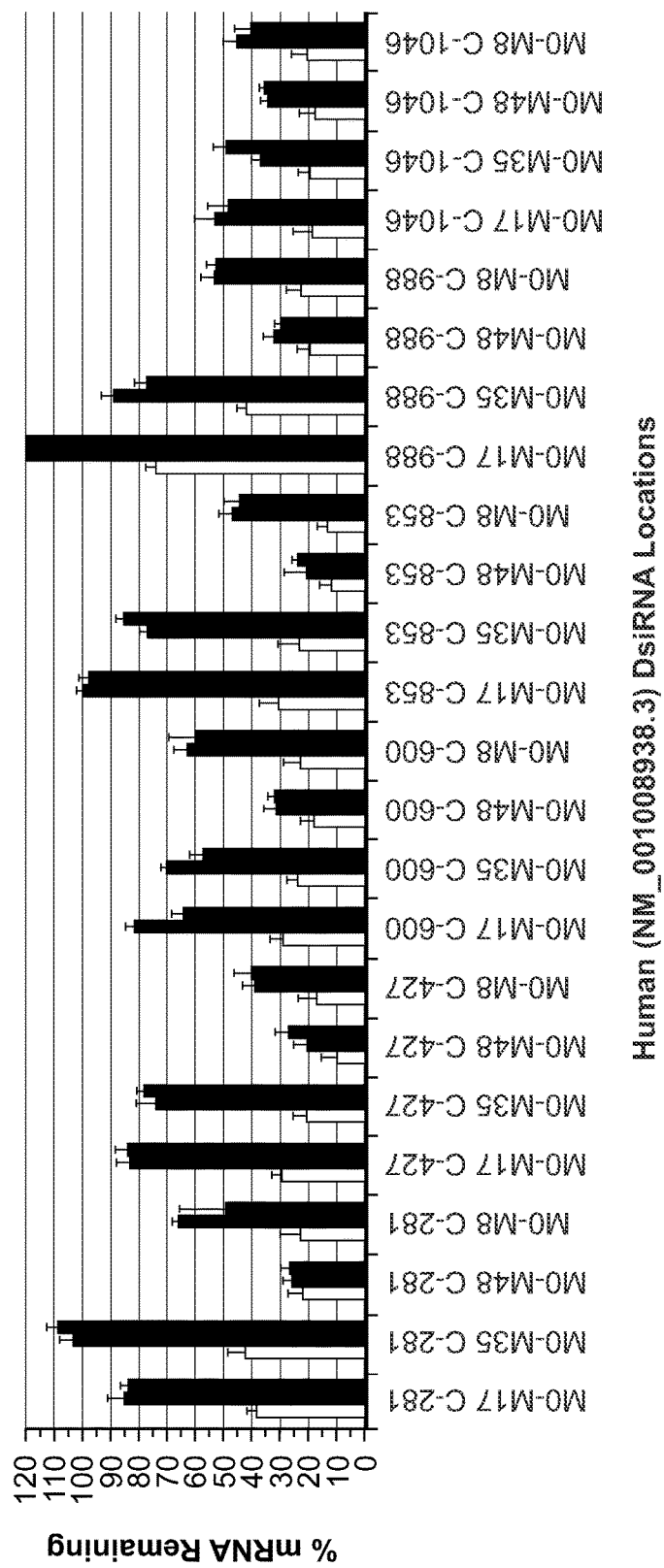
Figures 2B, 4:
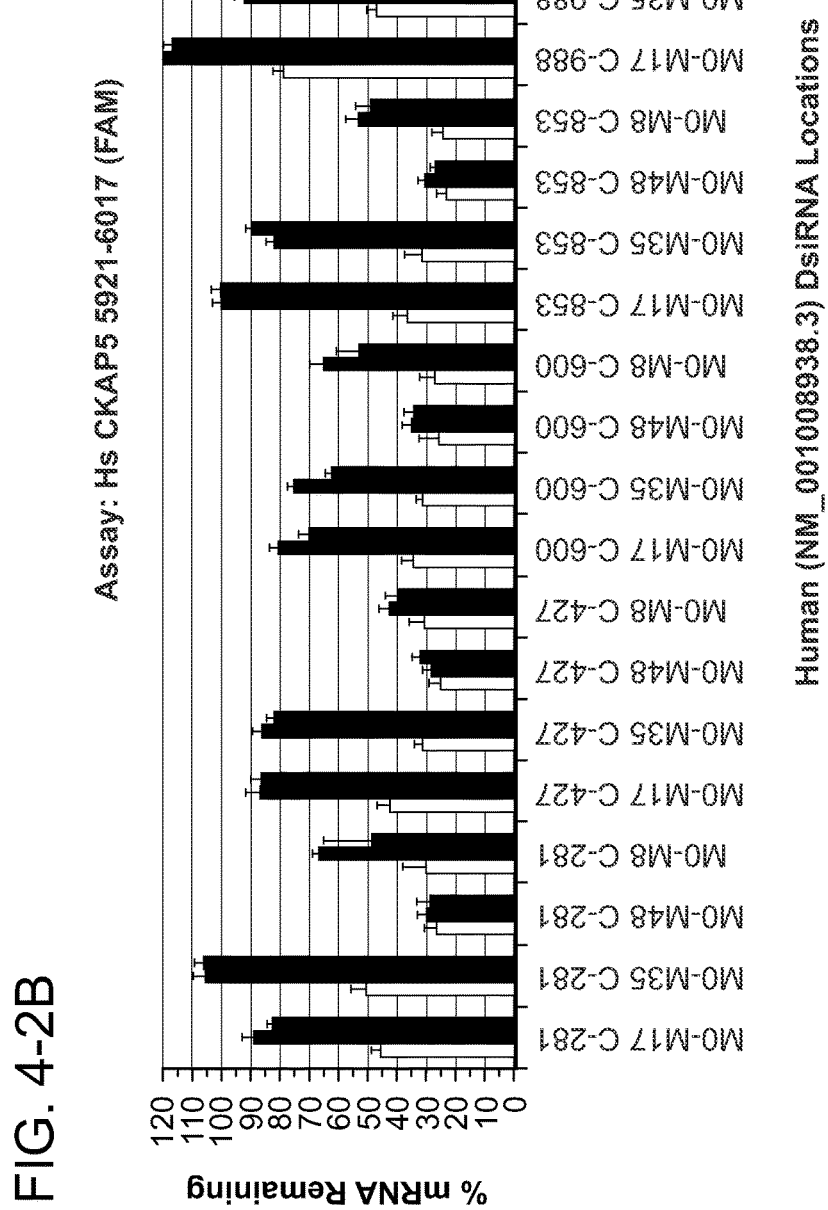
Figures 3A, 4:
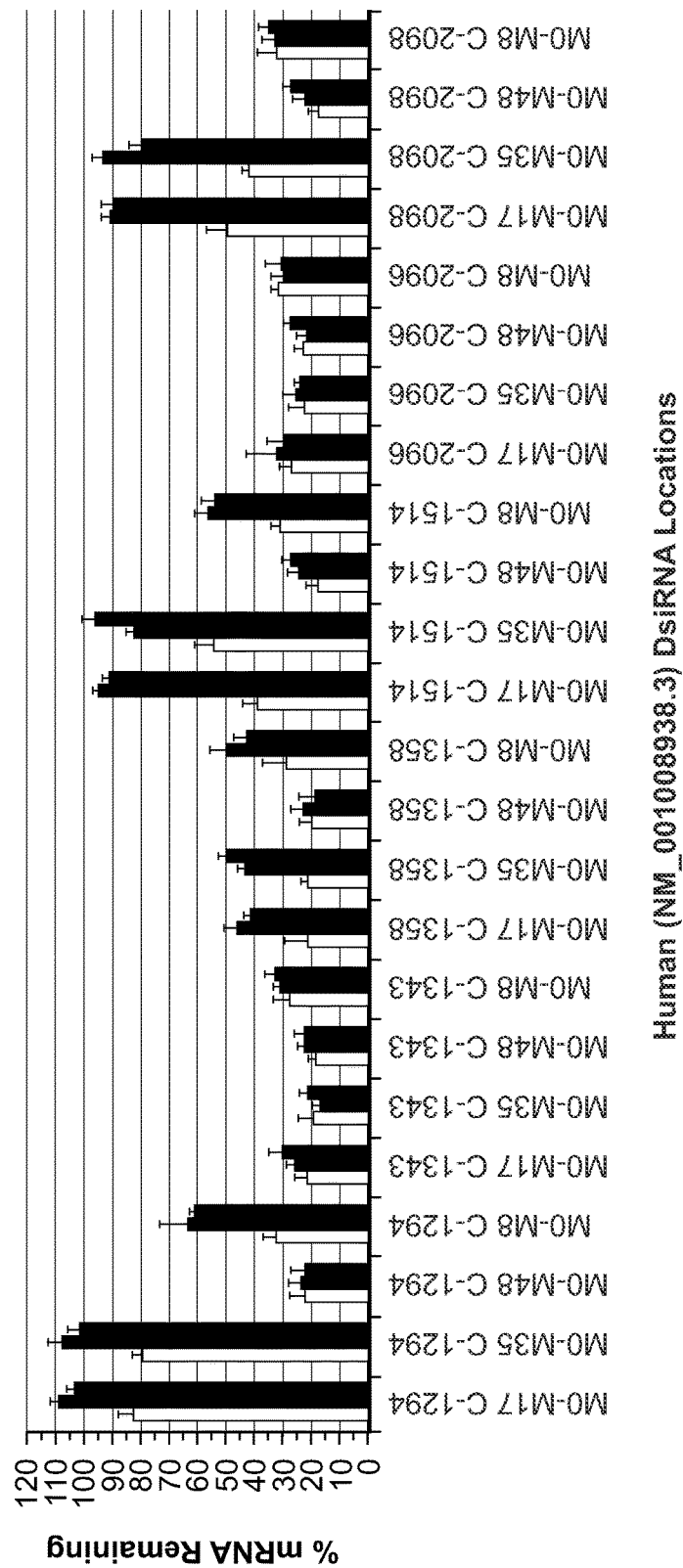
Figures 3B, 4:
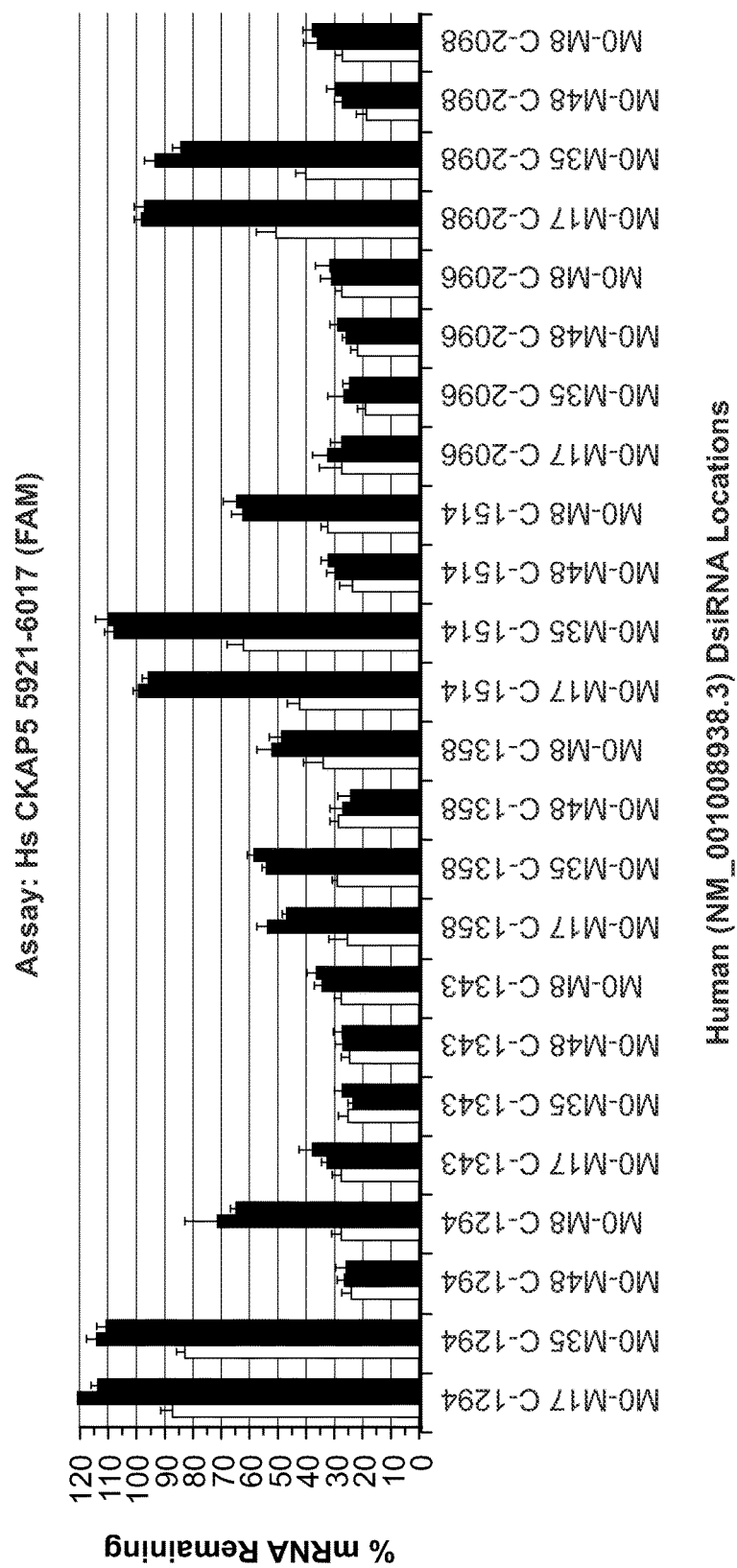
Figures 4, 4B:
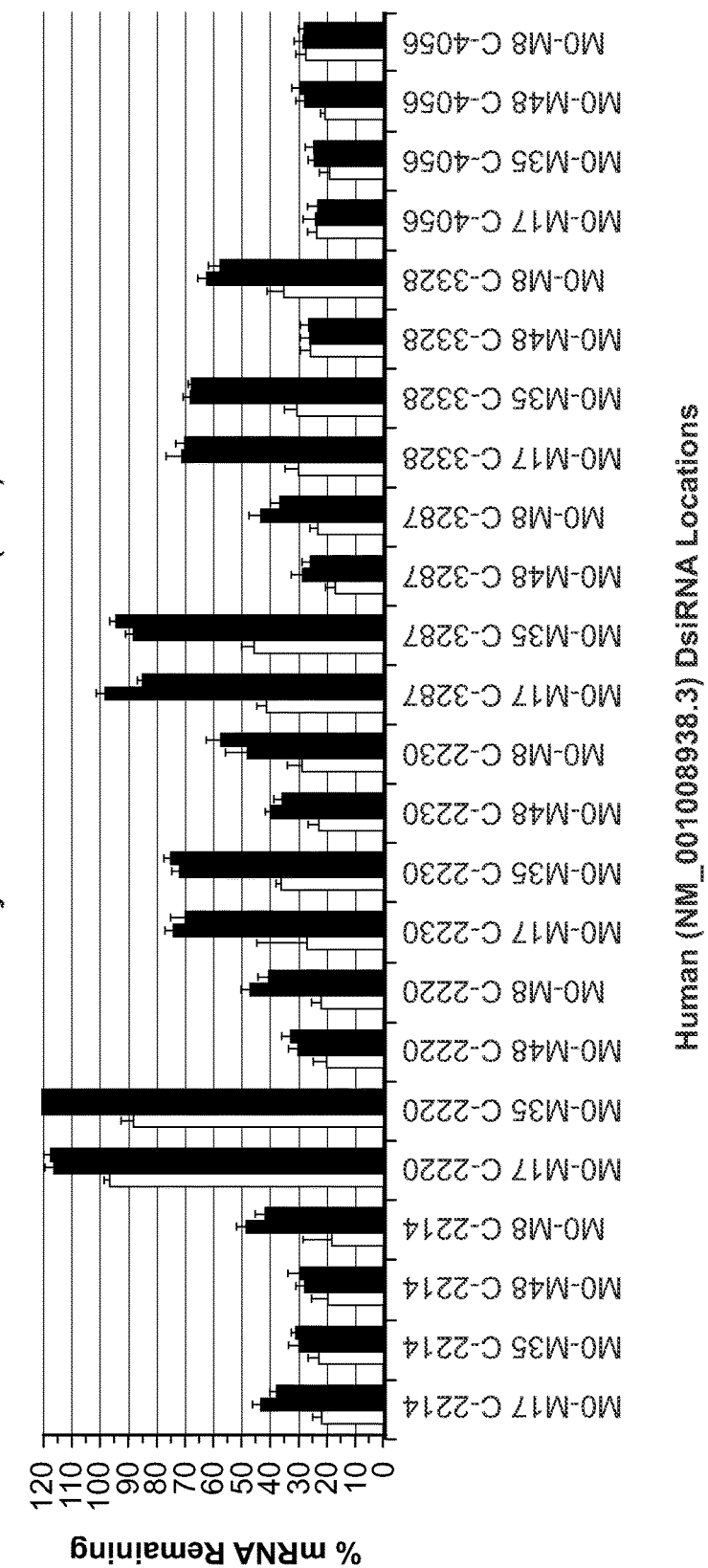
Figures 4, 5, 5A:
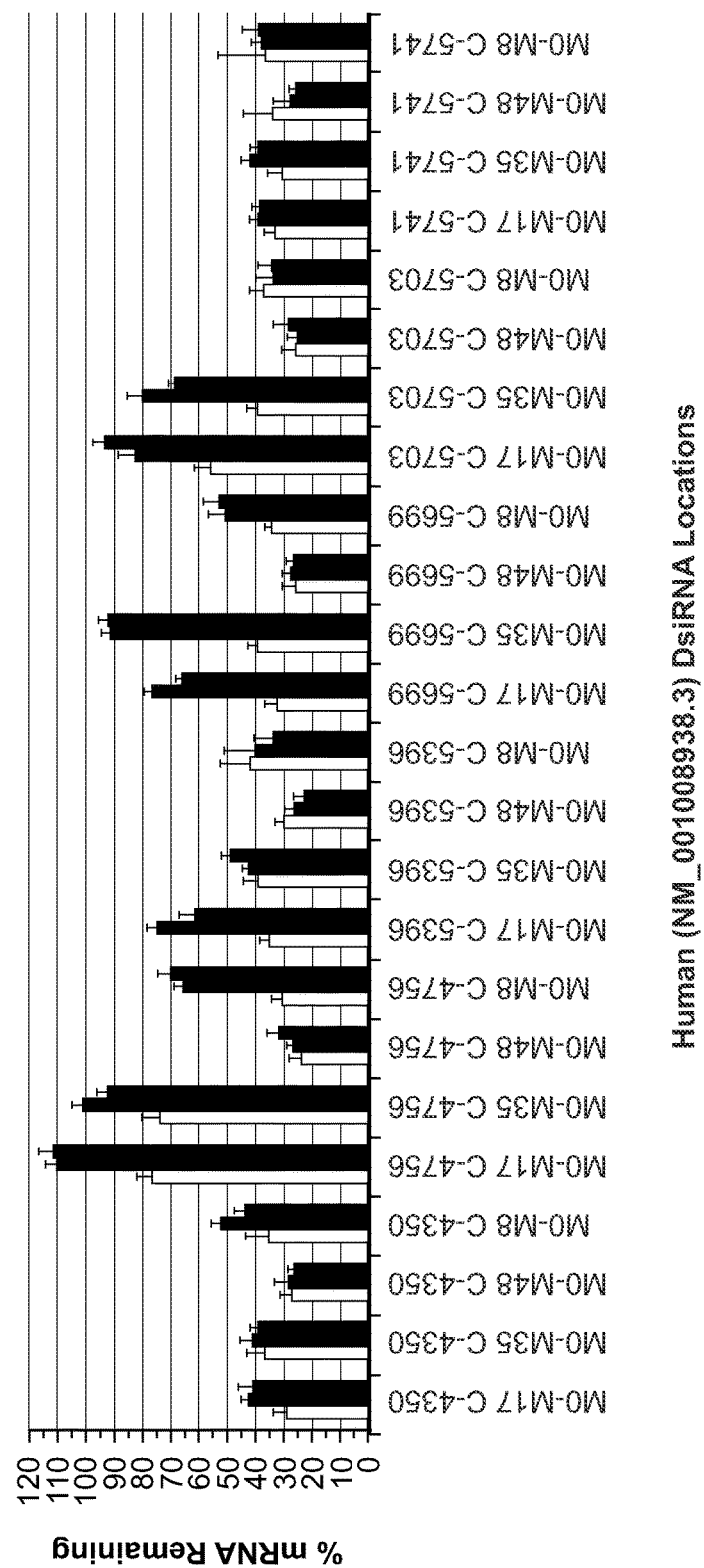
Figures 4, 5, 5B:
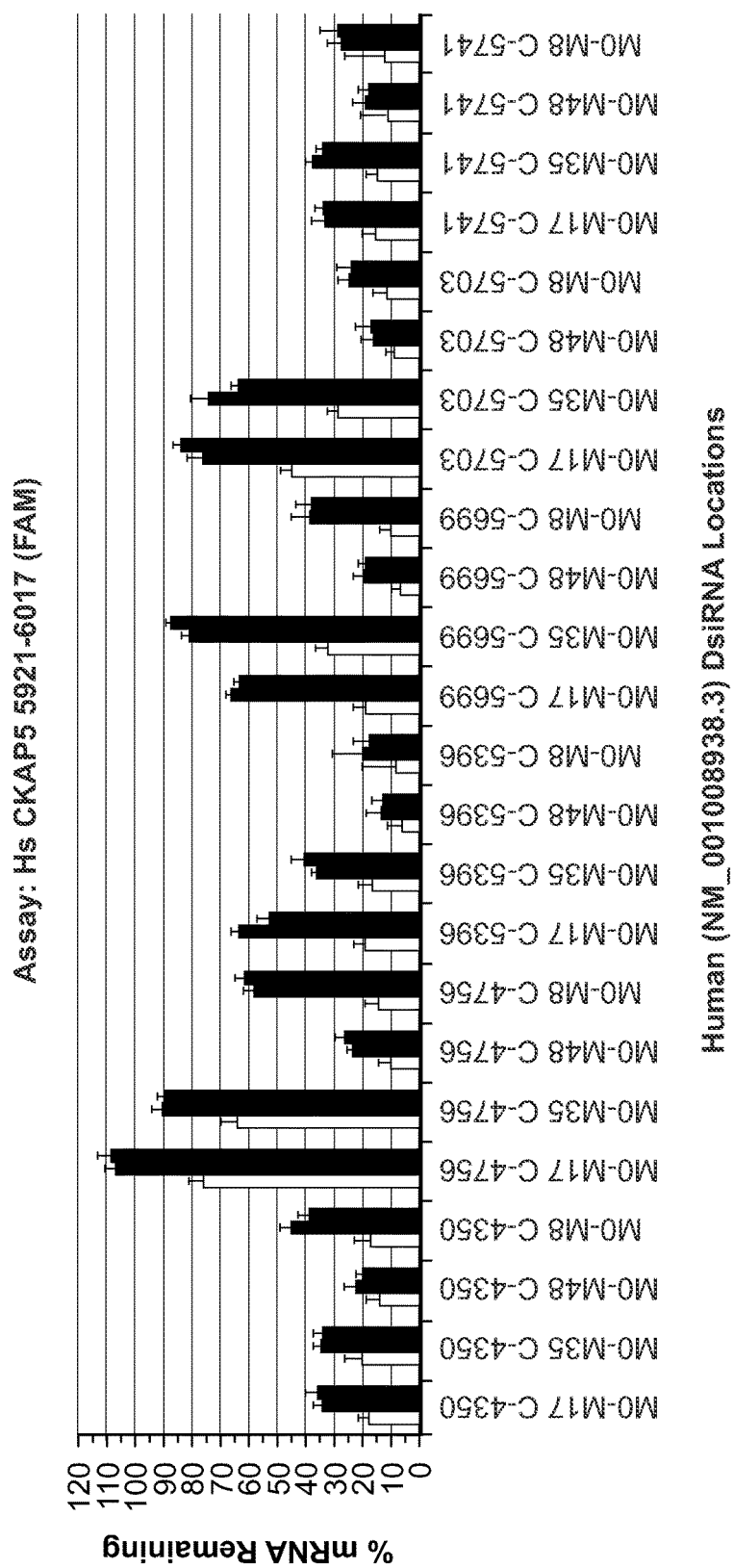
Figures 4, 5, 6, 6A:
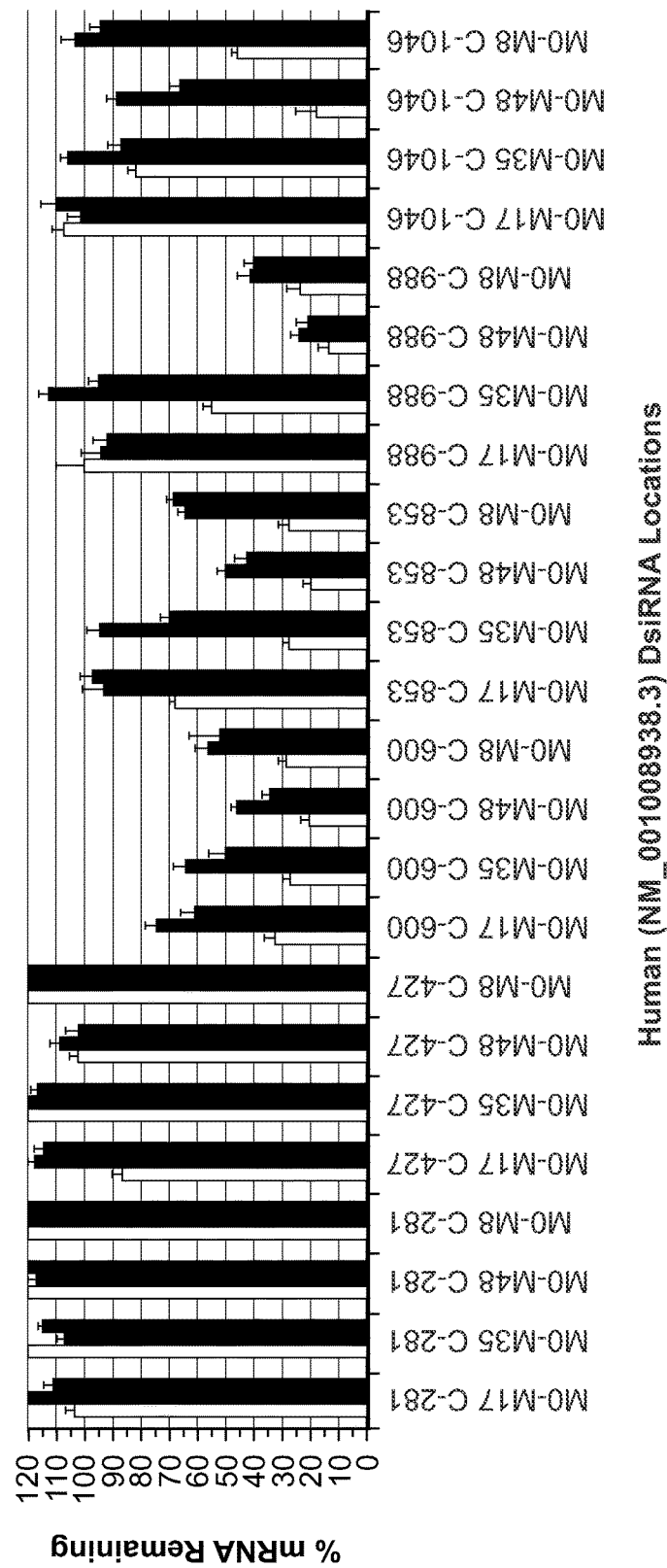
Figures 4, 5, 6, 6B:
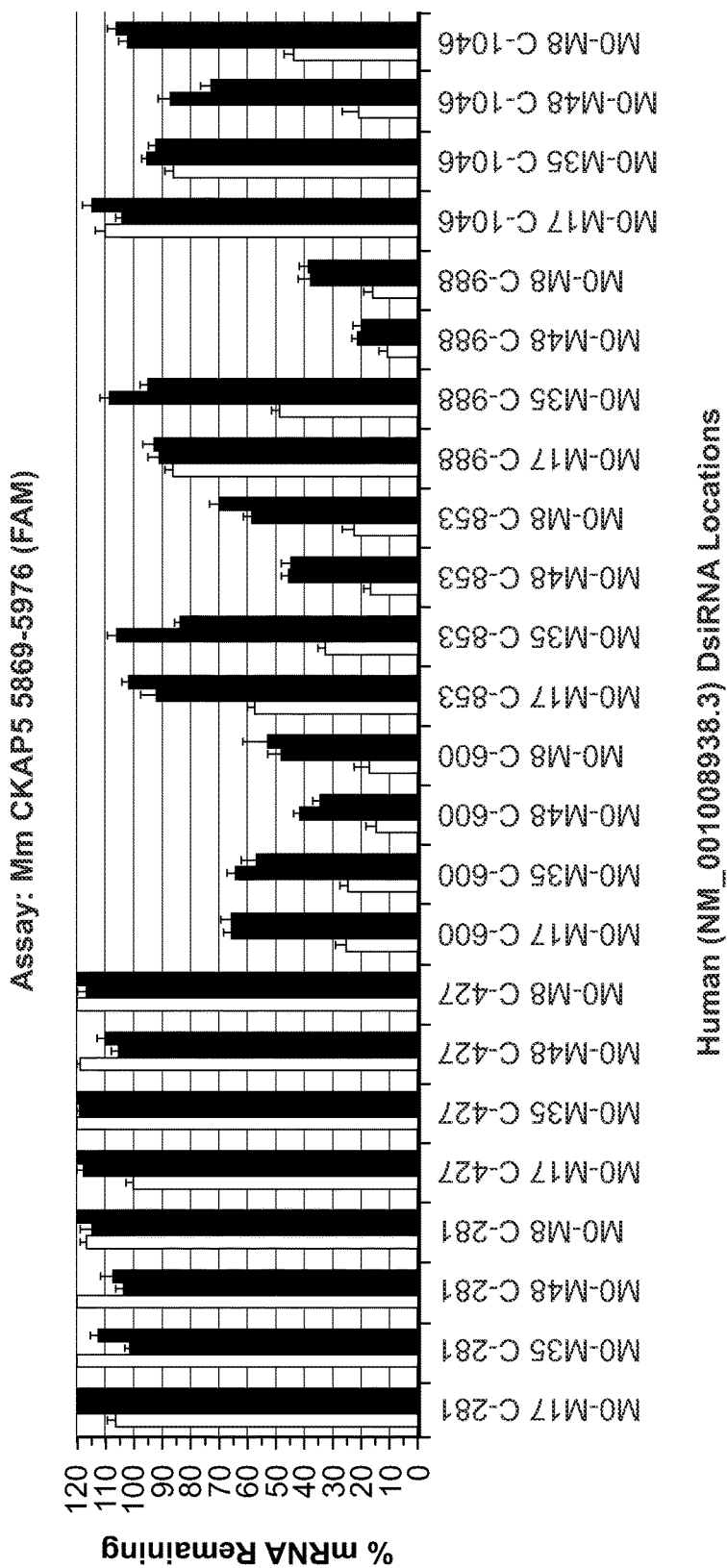
Figures 4, 5, 6, 7, 7A:
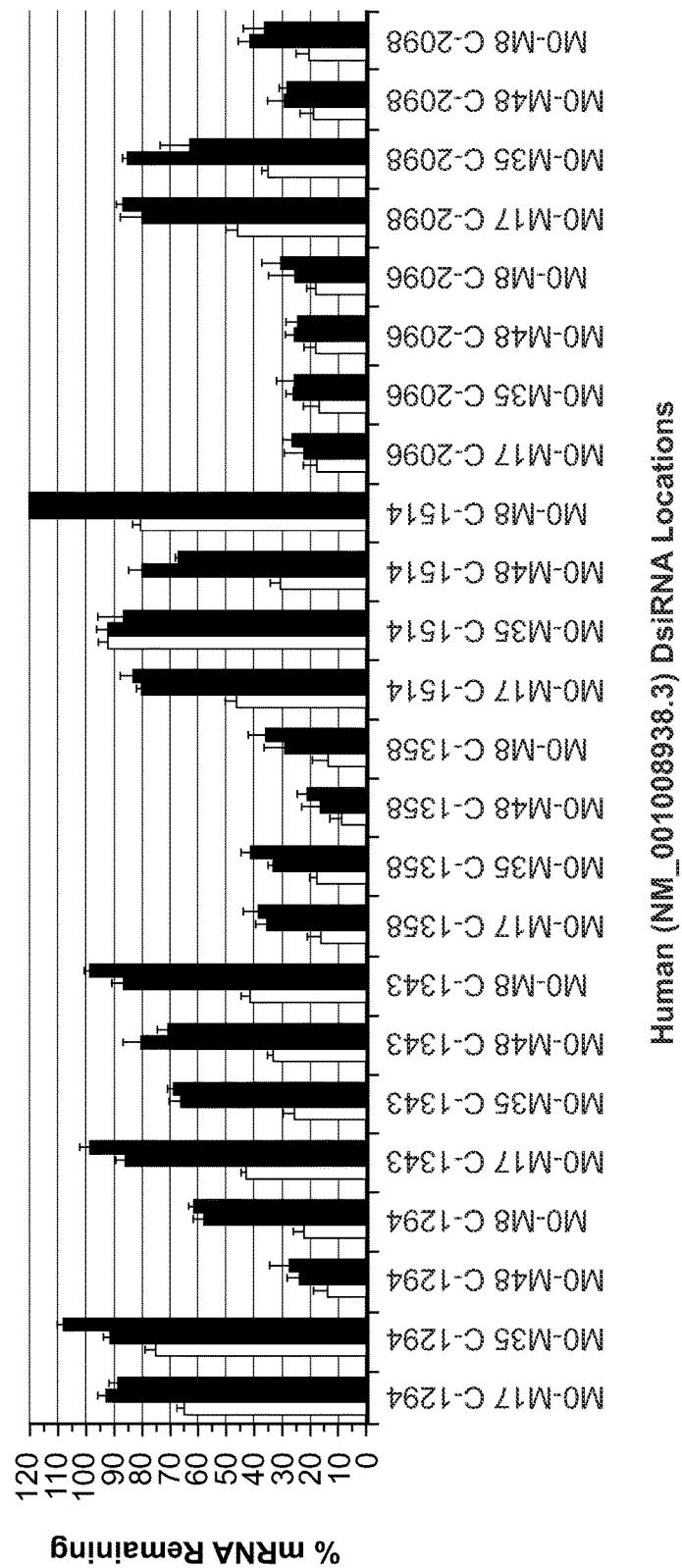
Figures 4, 5, 6, 7, 7B:
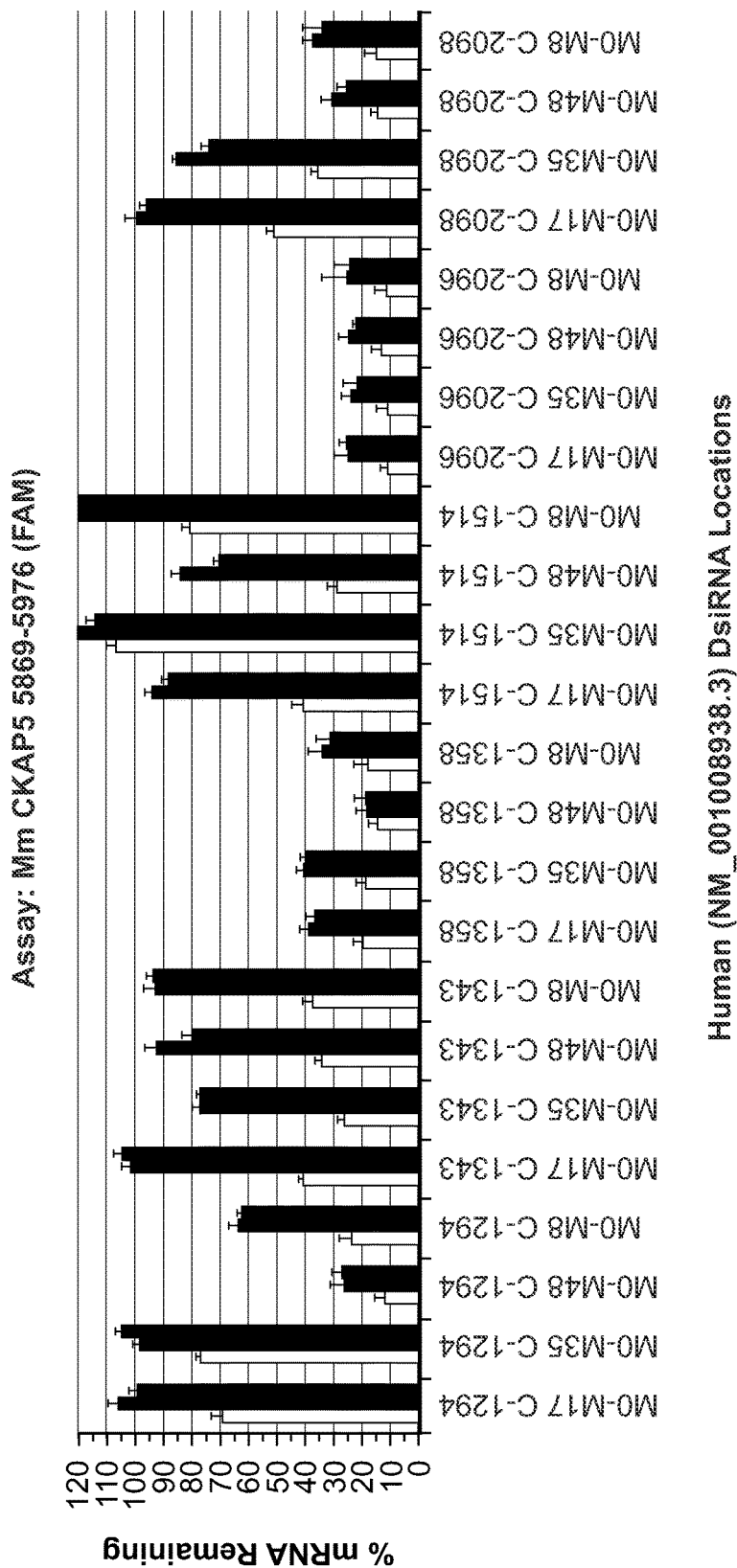
Figures 4, 5, 6, 7, 8, 8A:
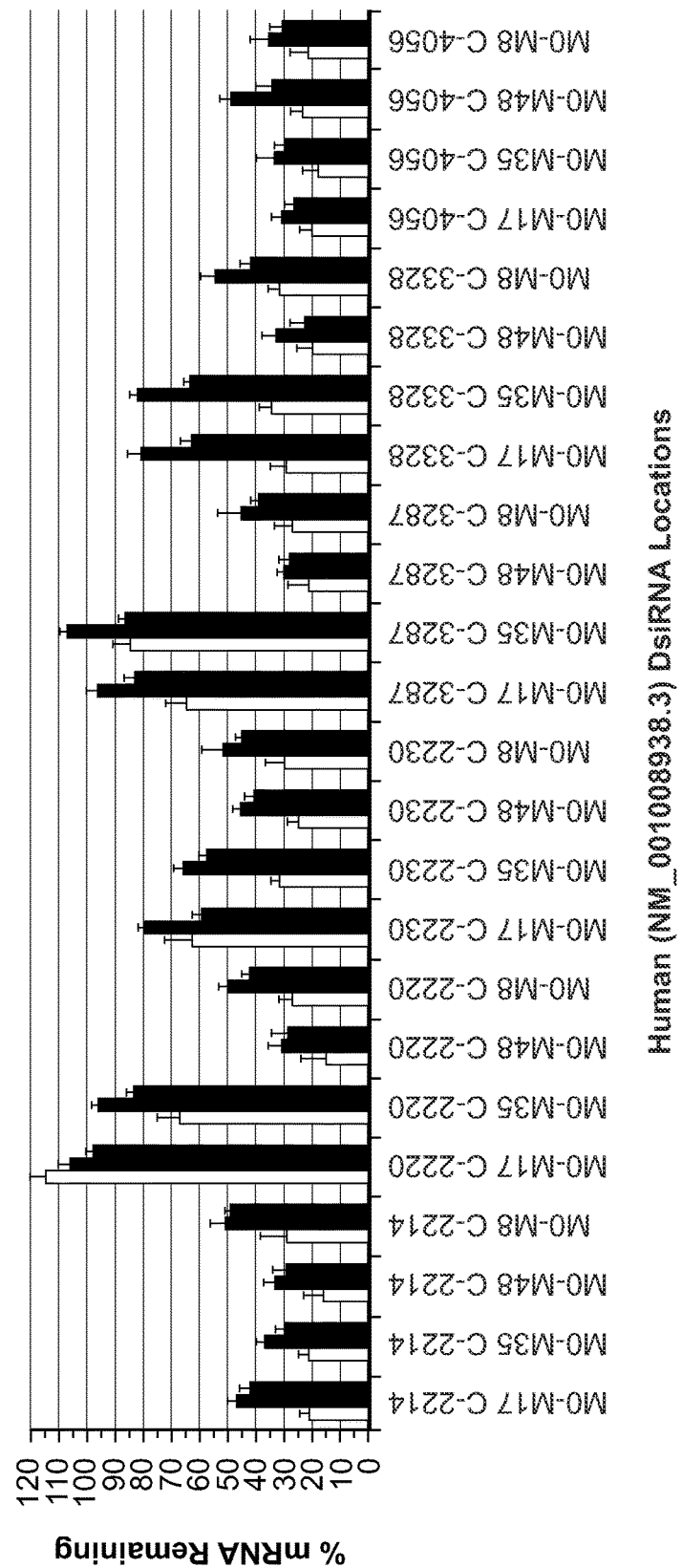
Figures 4, 5, 6, 7, 8, 8B:
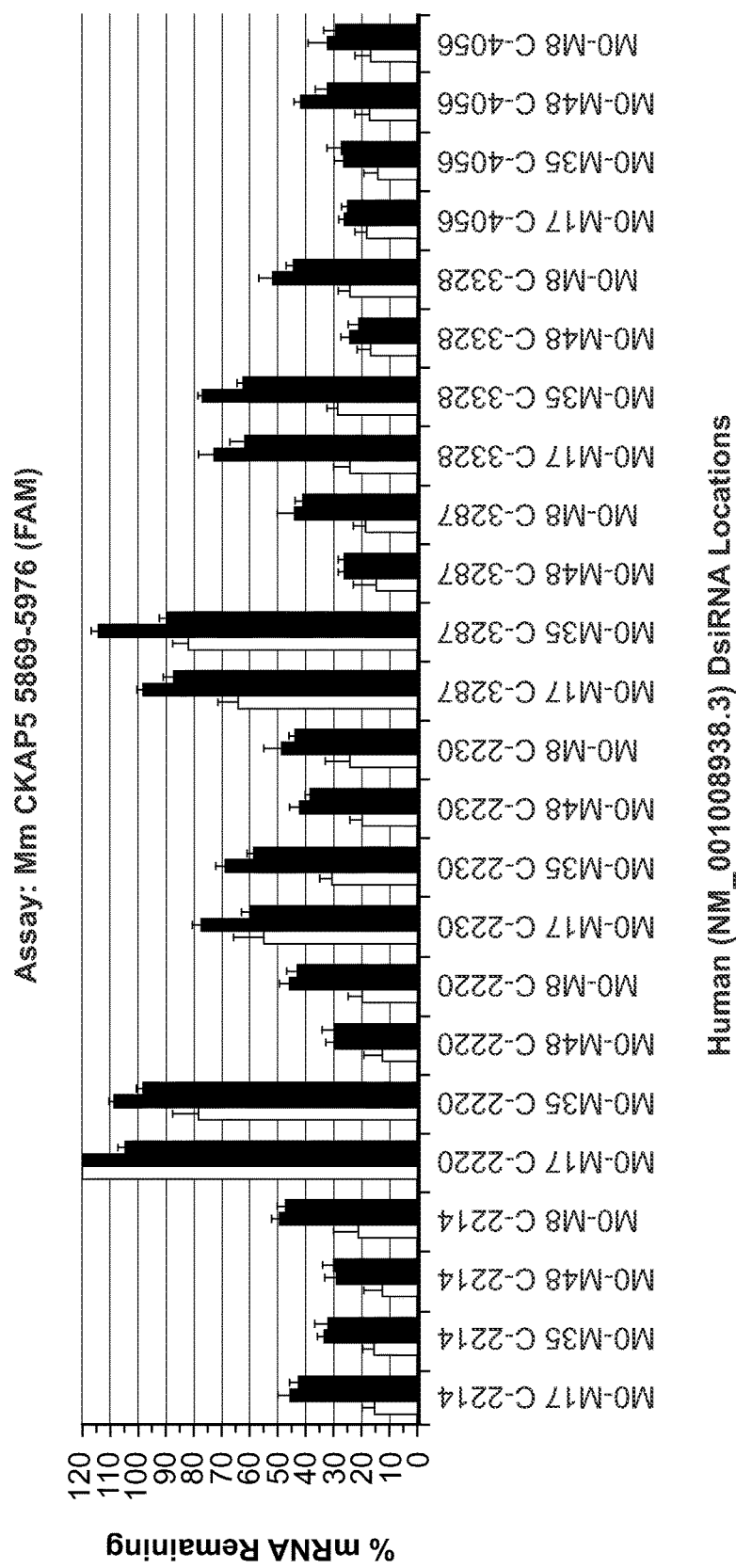
Figures 4, 5, 6, 7, 8, 9, 9A:
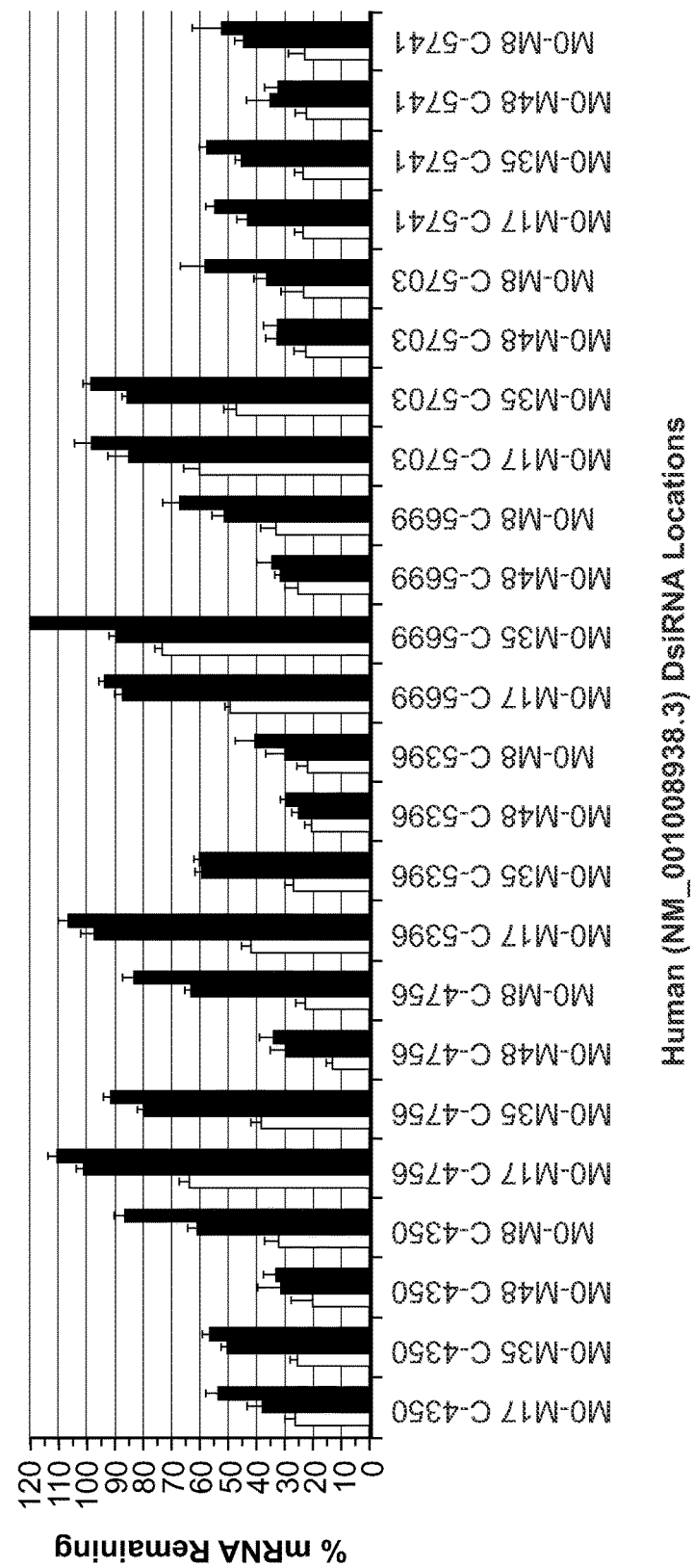
Figures 4, 5, 6, 7, 8, 9, 9B:
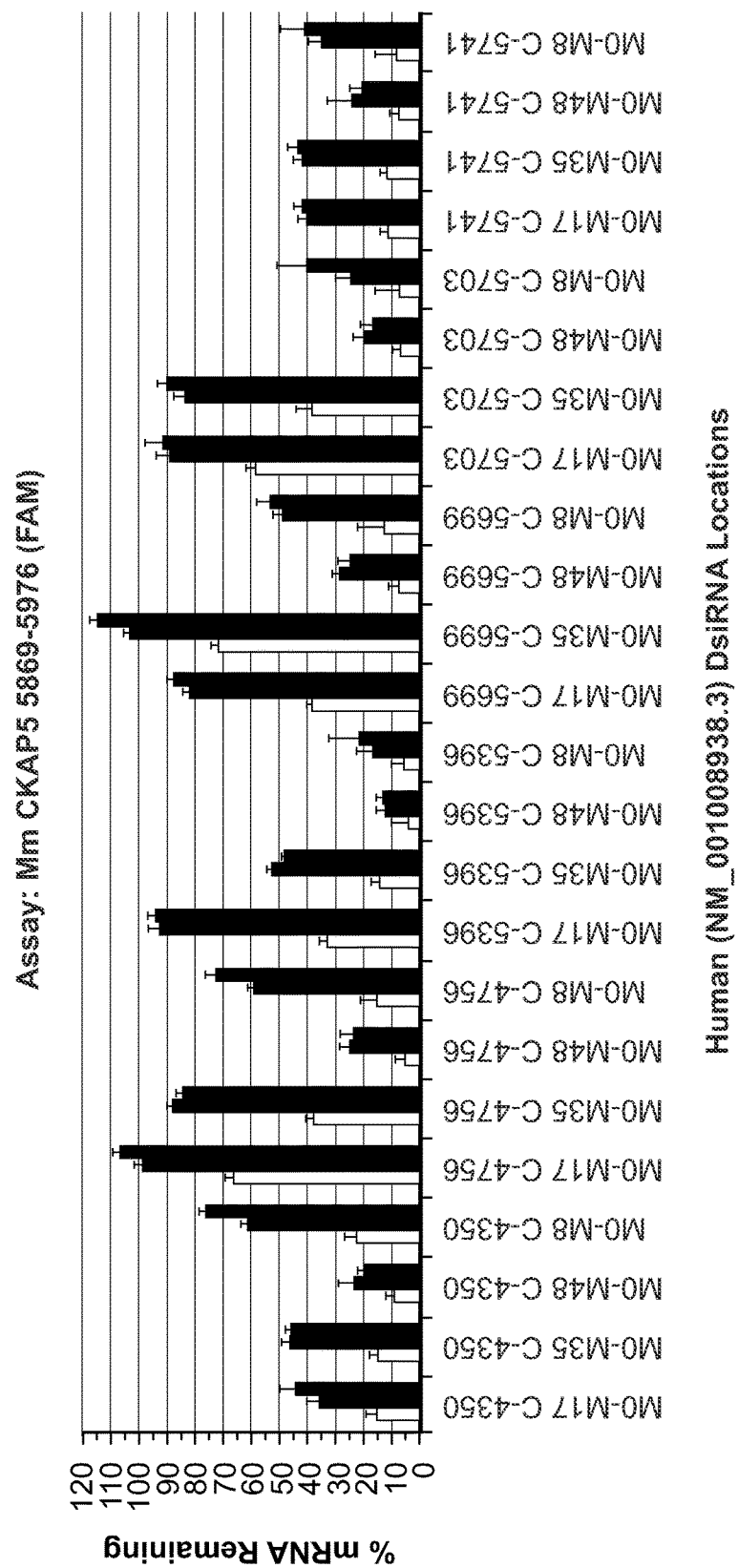
Figures 3A, 5:
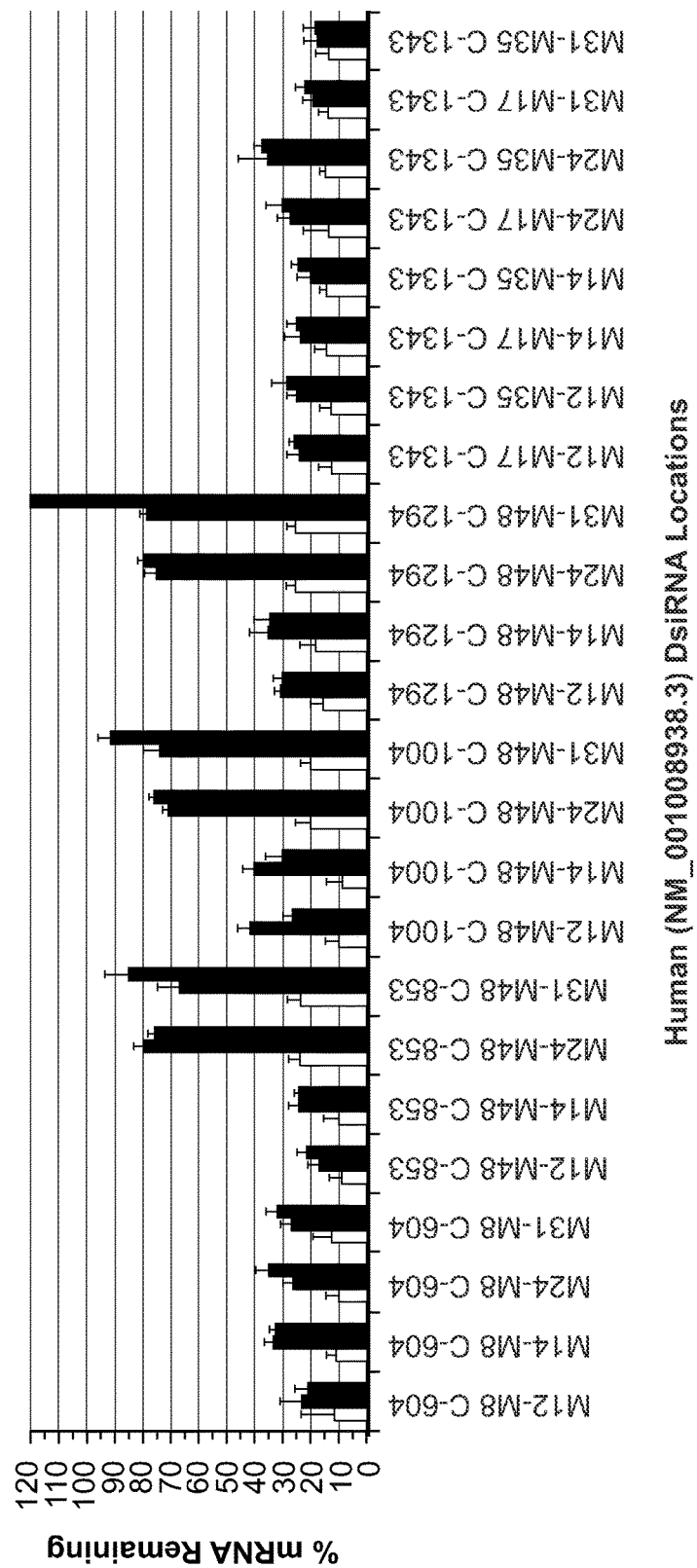
Figures 4A, 5:
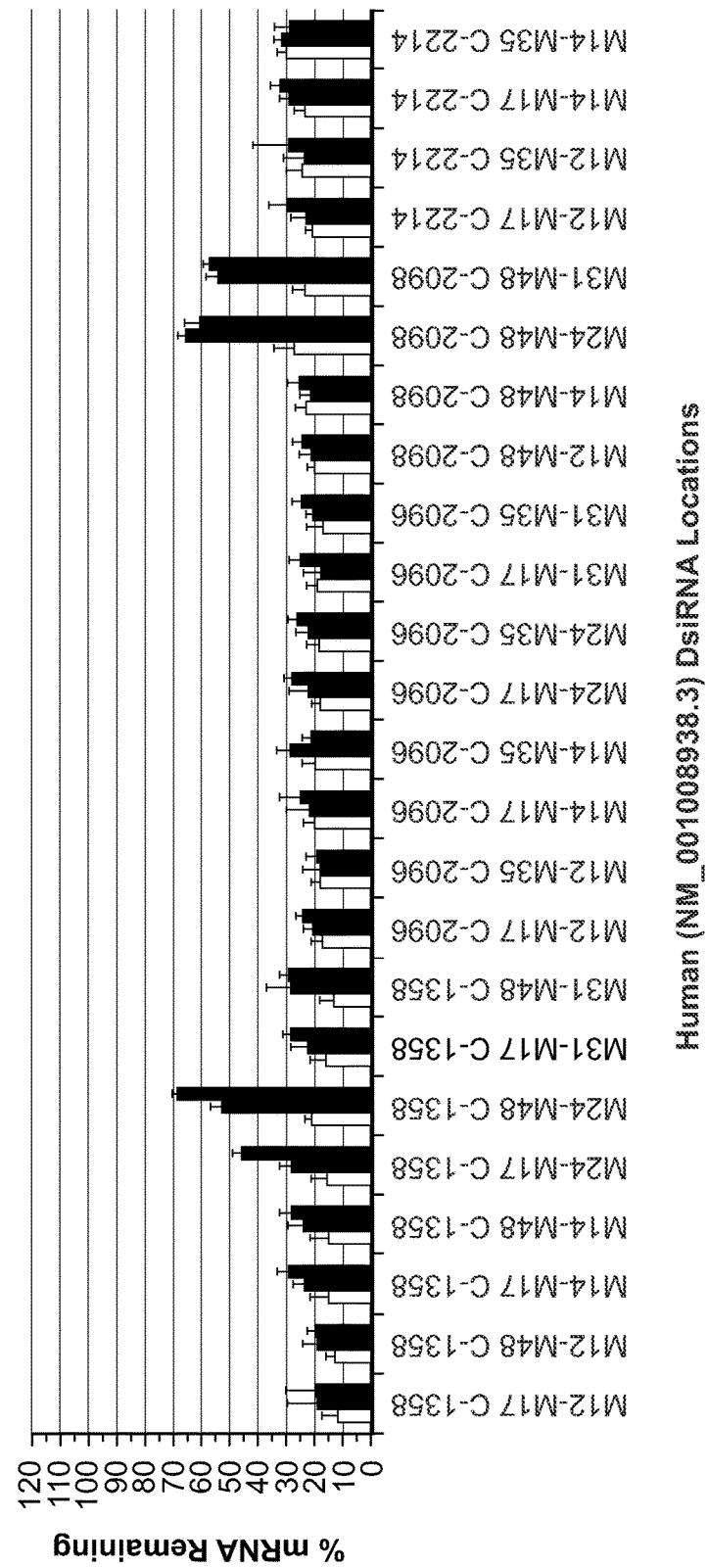
Figures 4B, 5:
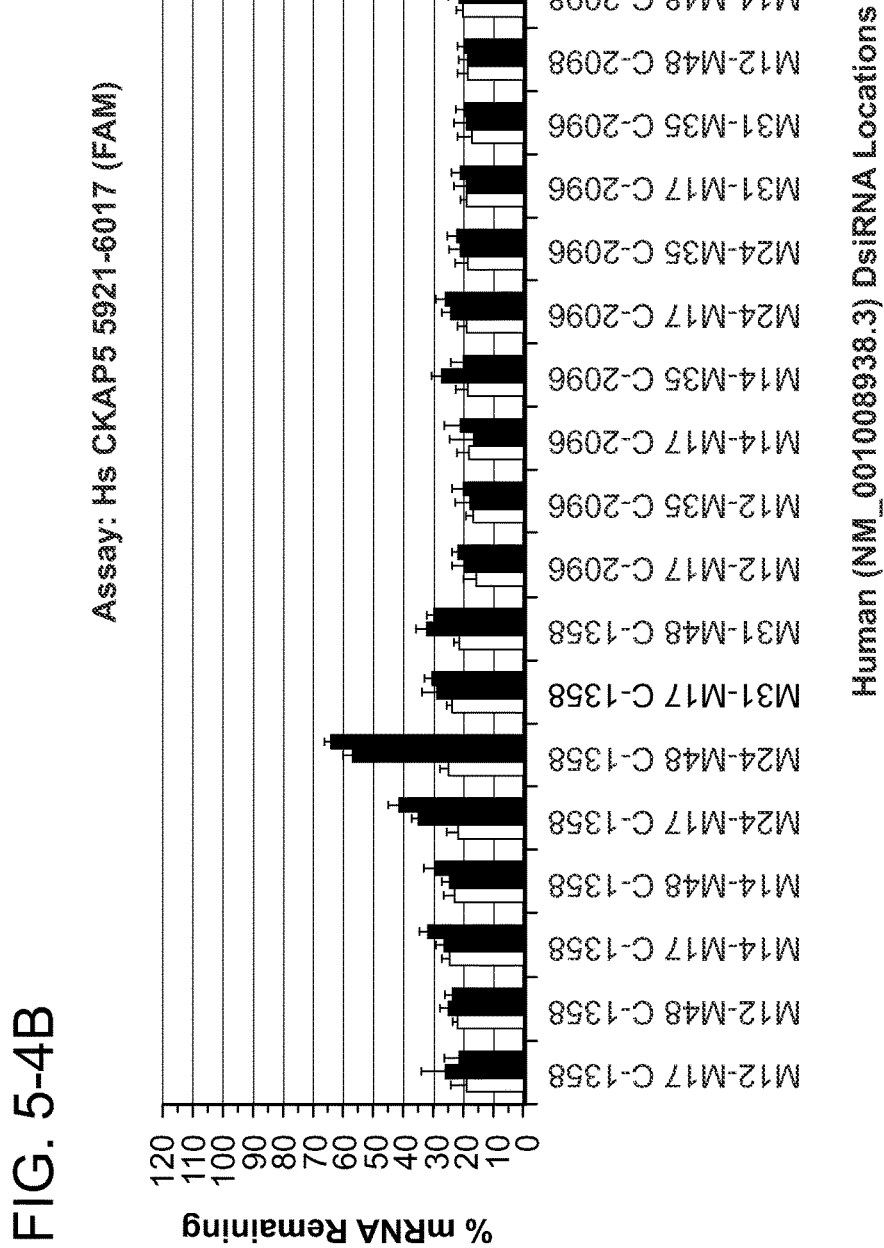
Figures 5, 5A:
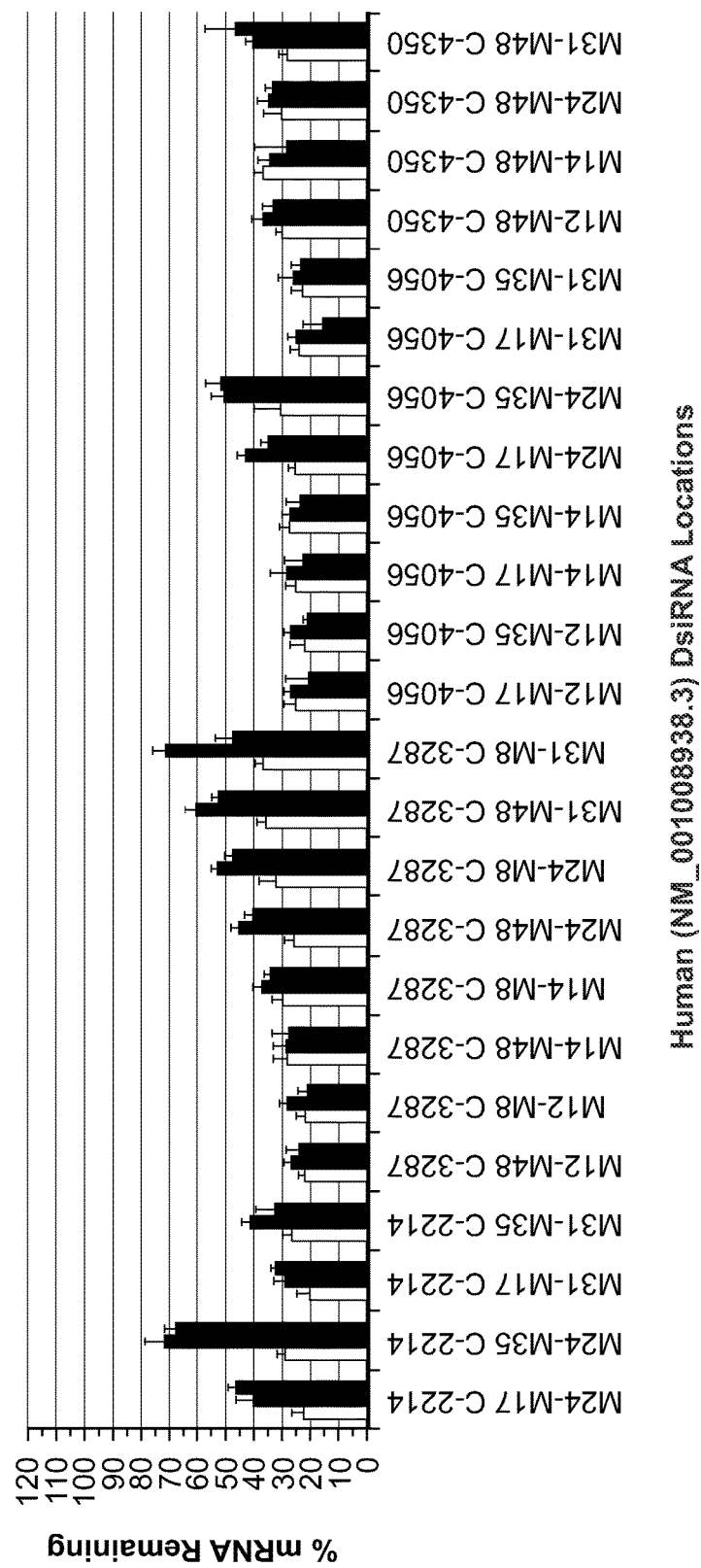
Figures 5, 5B:
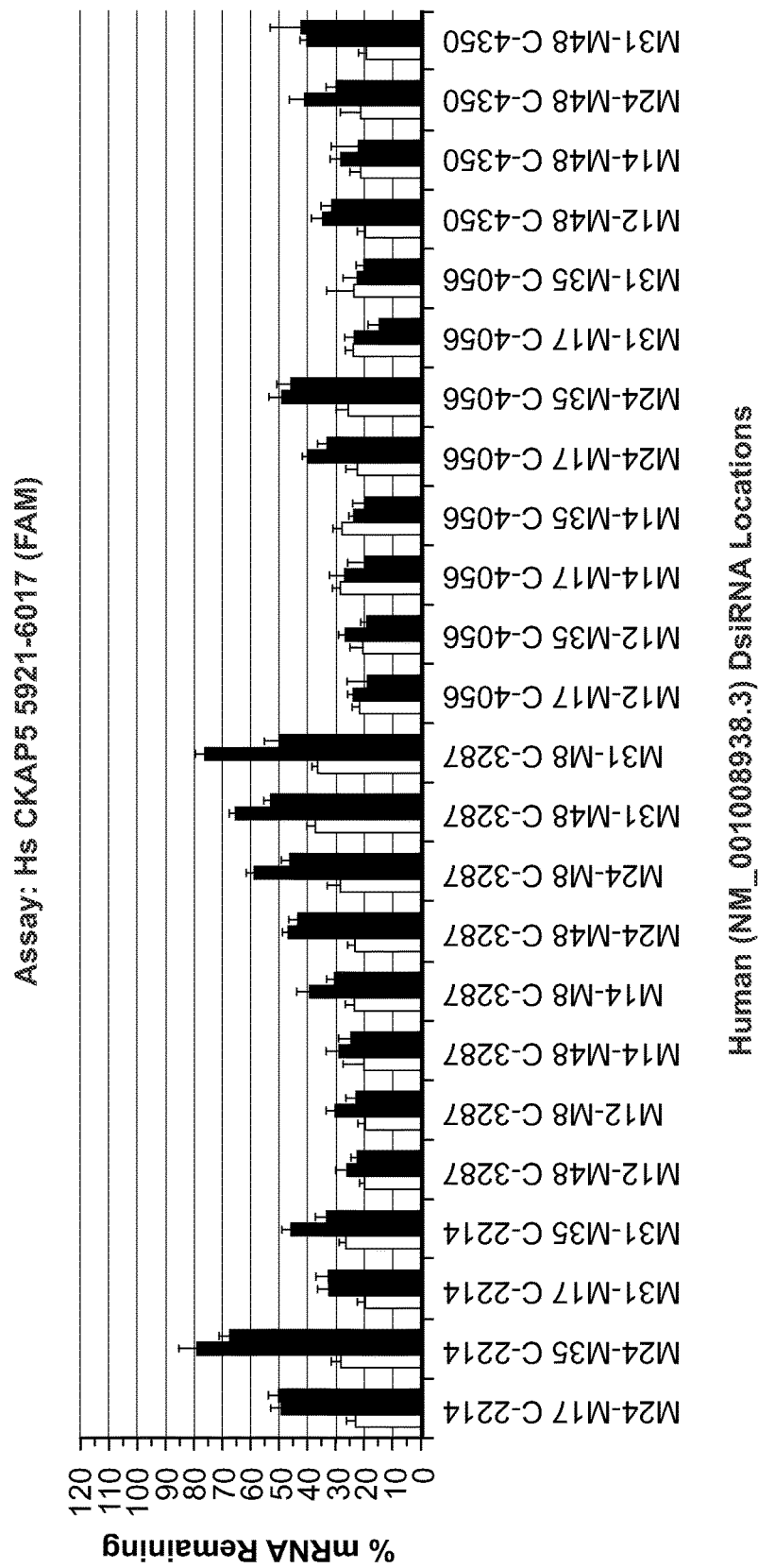
Figures 5, 6, 6A:
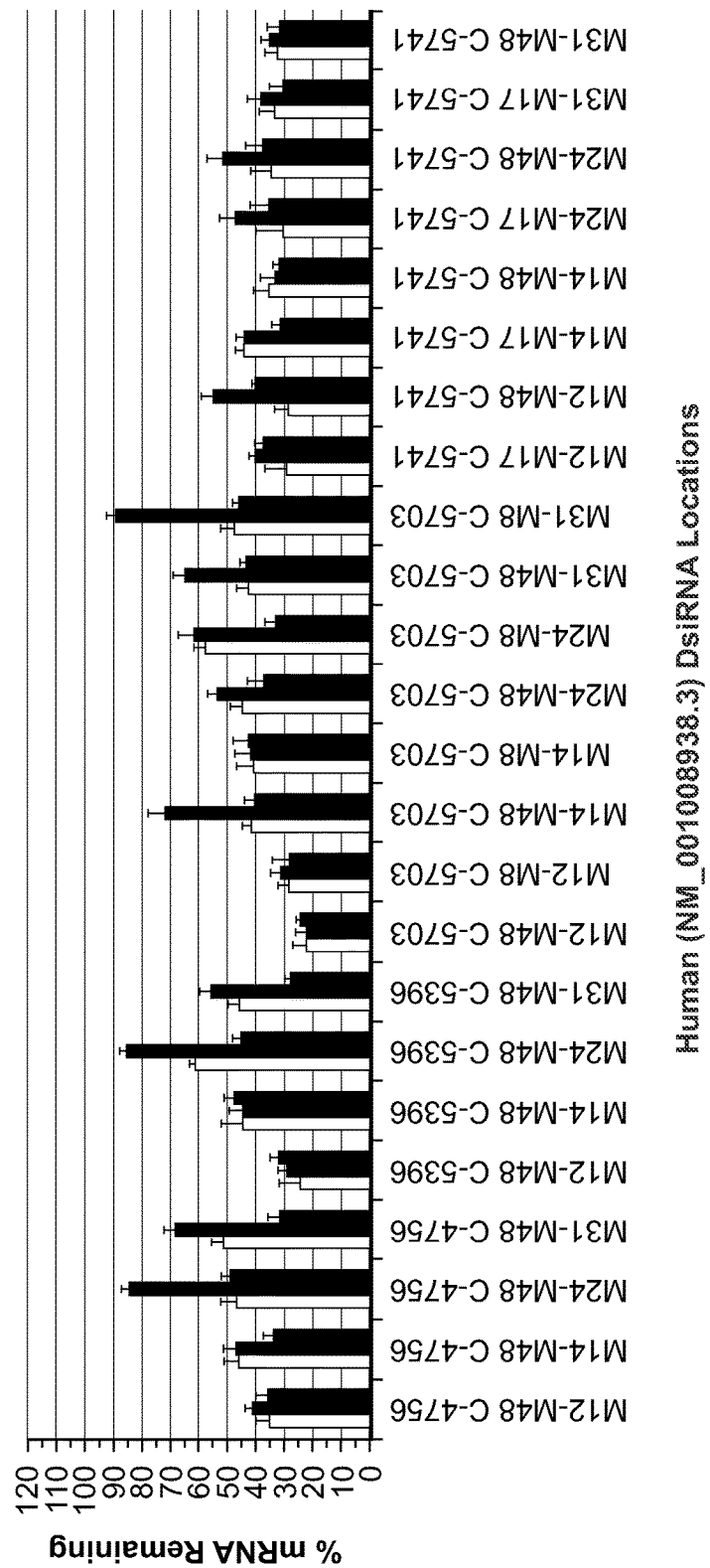
Figures 5, 6, 6B:
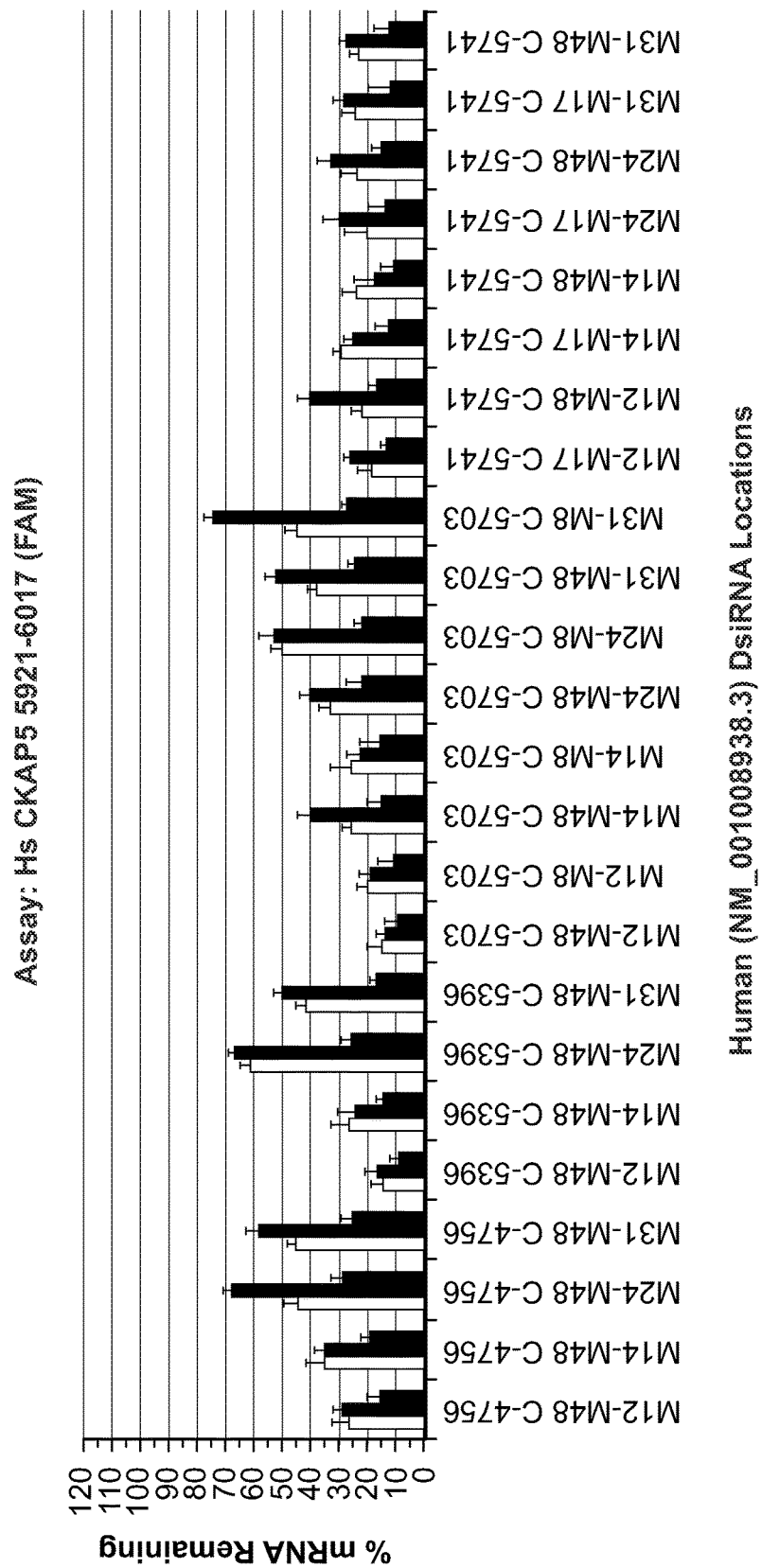
Figures 1, 6:
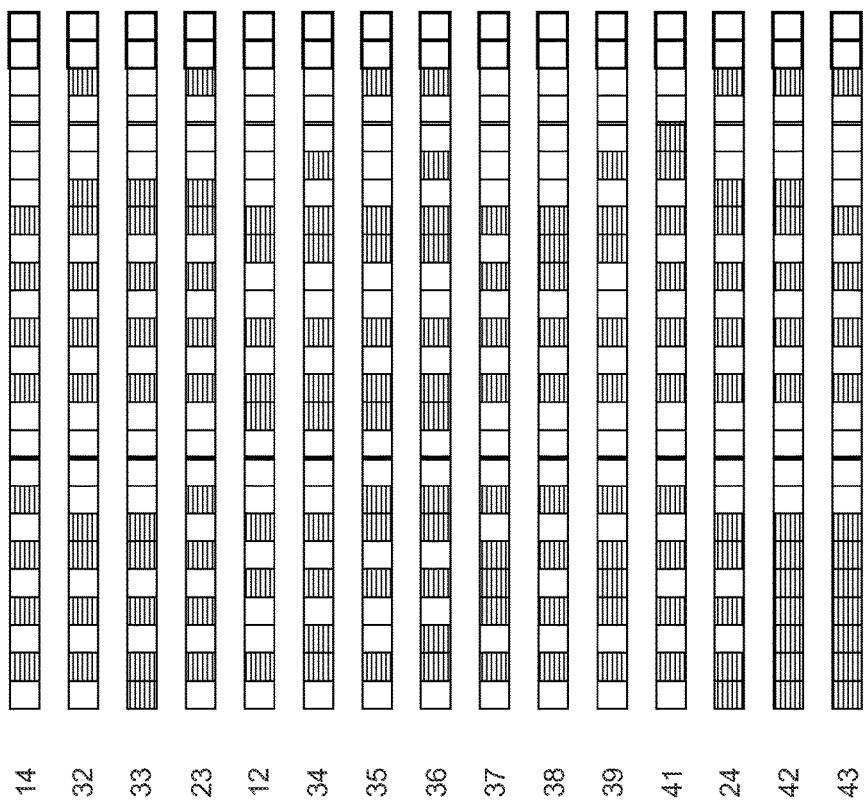
Figures 2, 6:
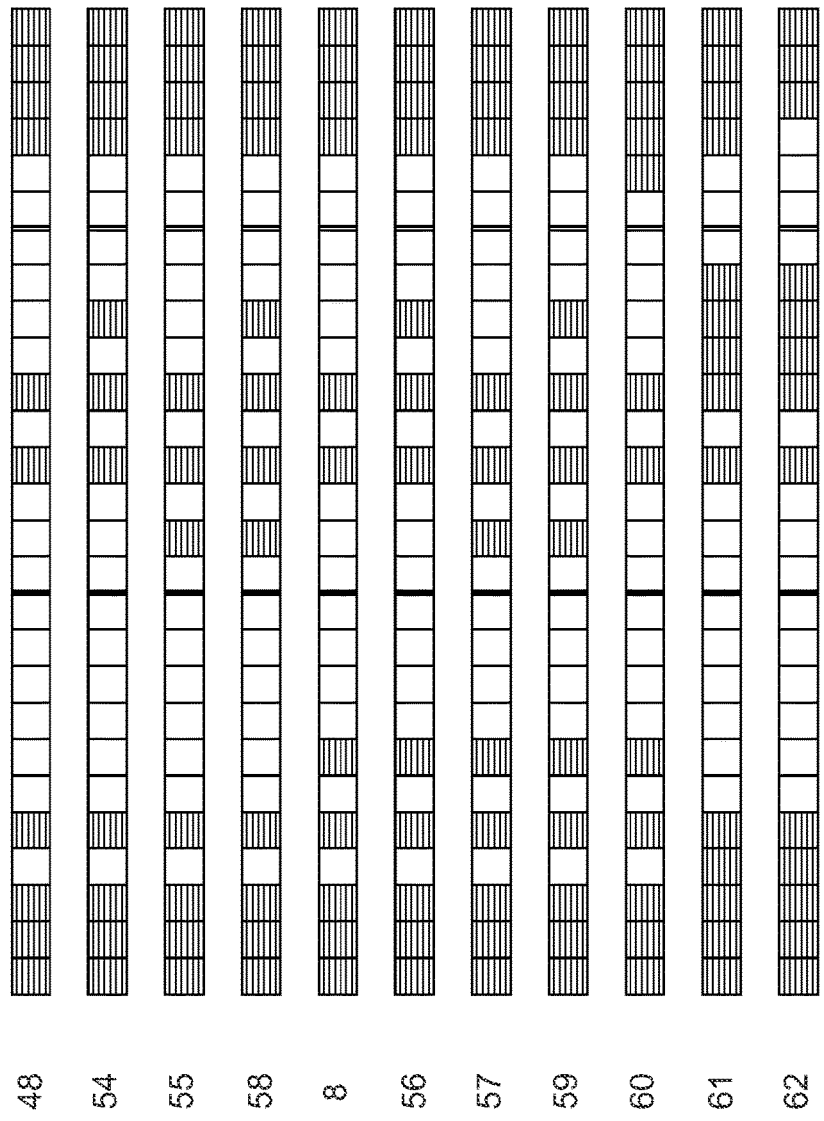
Figures 3, 6:
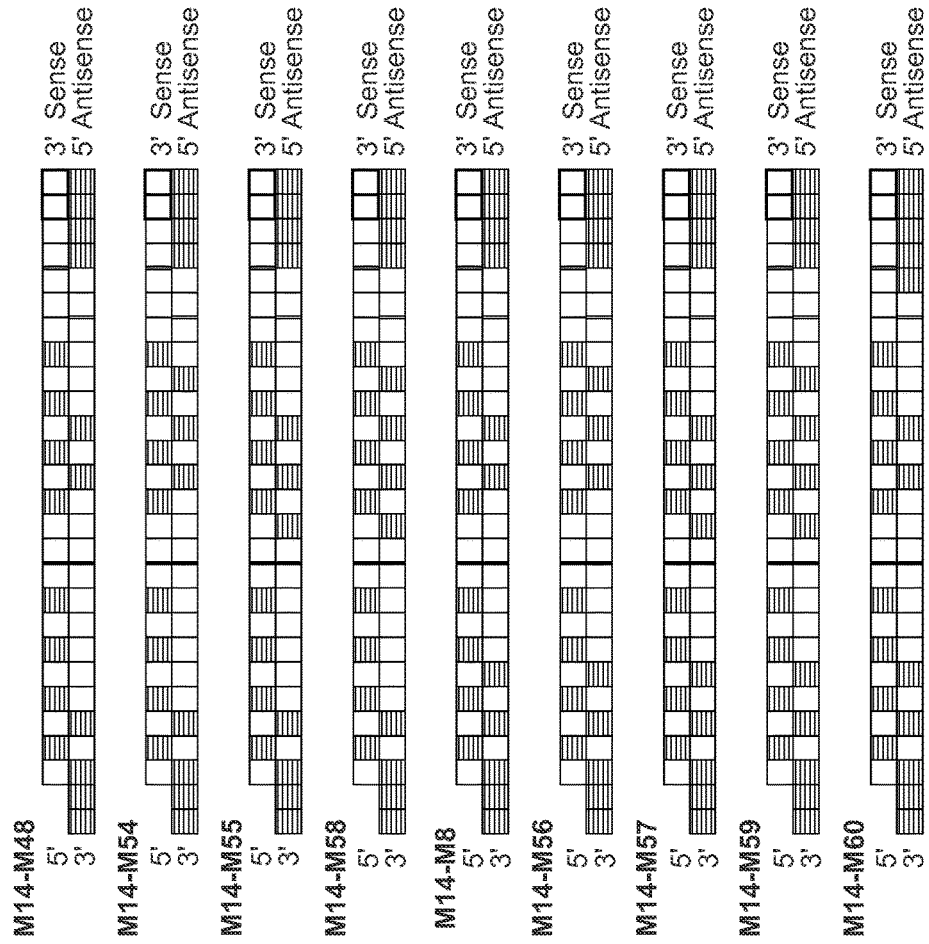
Figures 6, 7, 8, 9, 10, 11, 12, 13, 14, 15, 16, 16A:
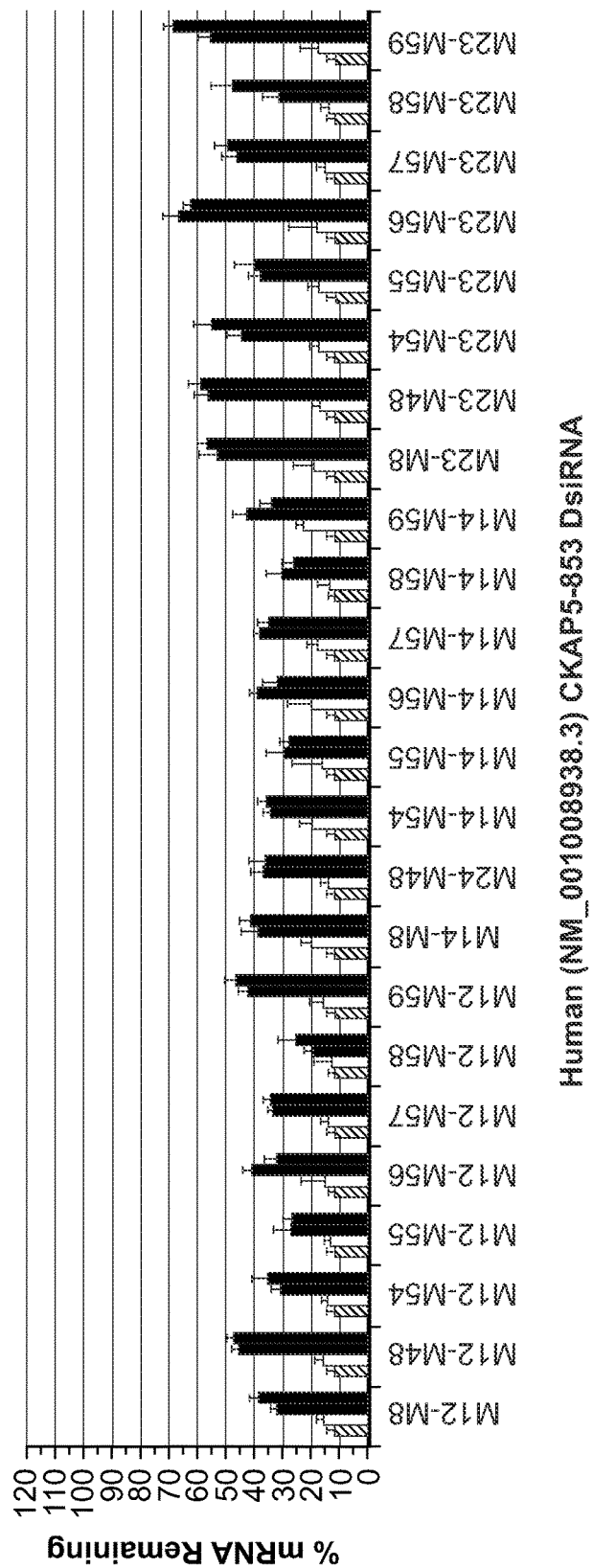
Figures 6, 7, 8, 9, 10, 11, 12, 13, 14, 15, 16, 16B:
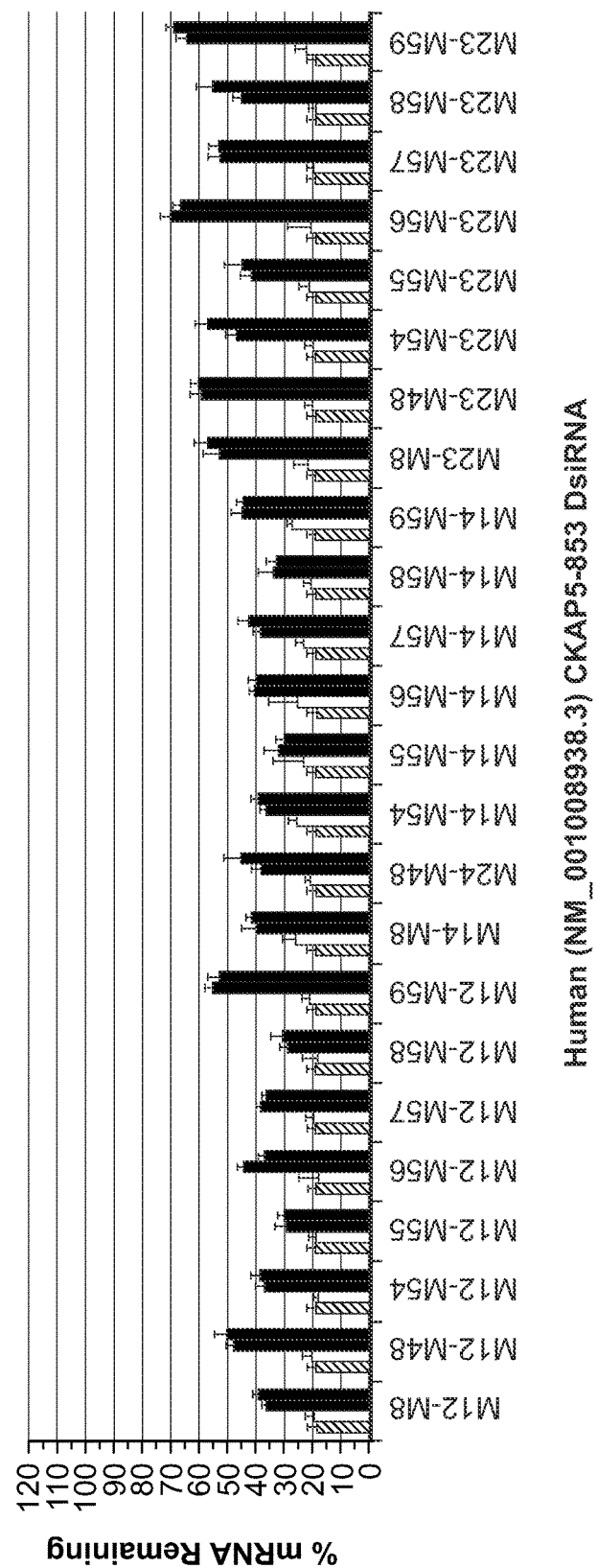
Figures 6, 7, 8, 9, 10, 11, 12, 13, 14, 15, 16, 17, 17A:
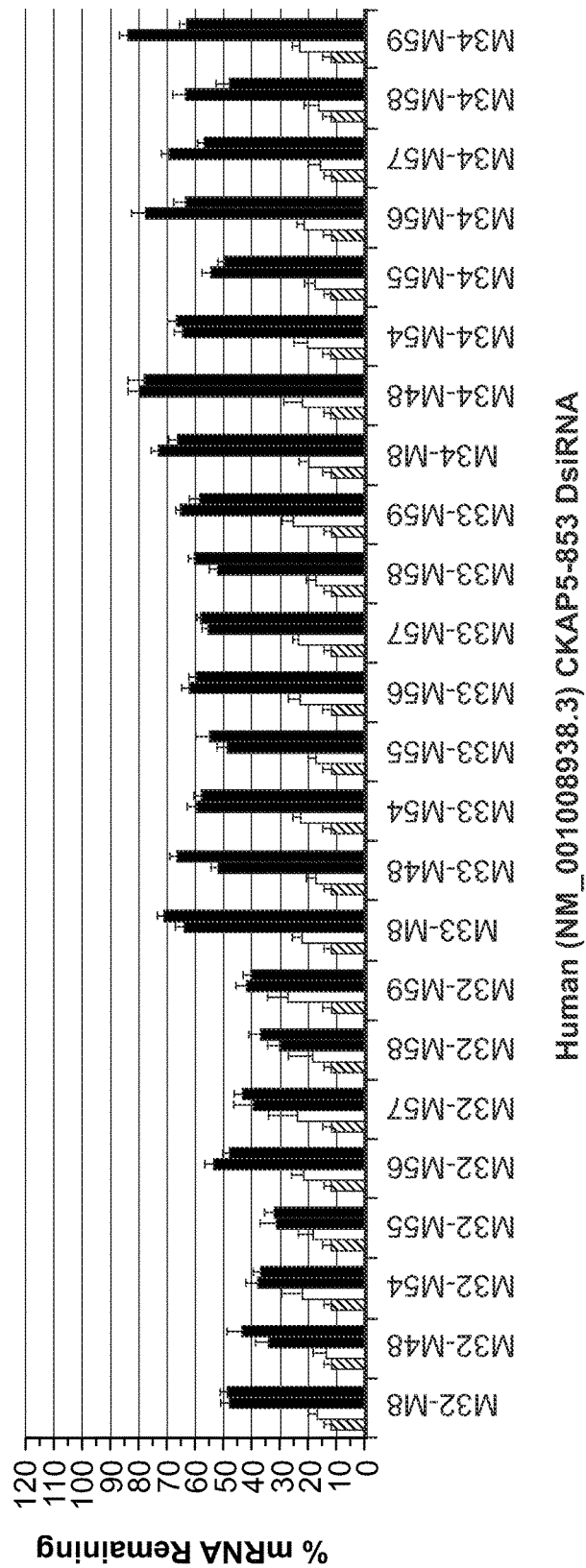
Figures 6, 7, 8, 9, 10, 11, 12, 13, 14, 15, 16, 17, 17B:
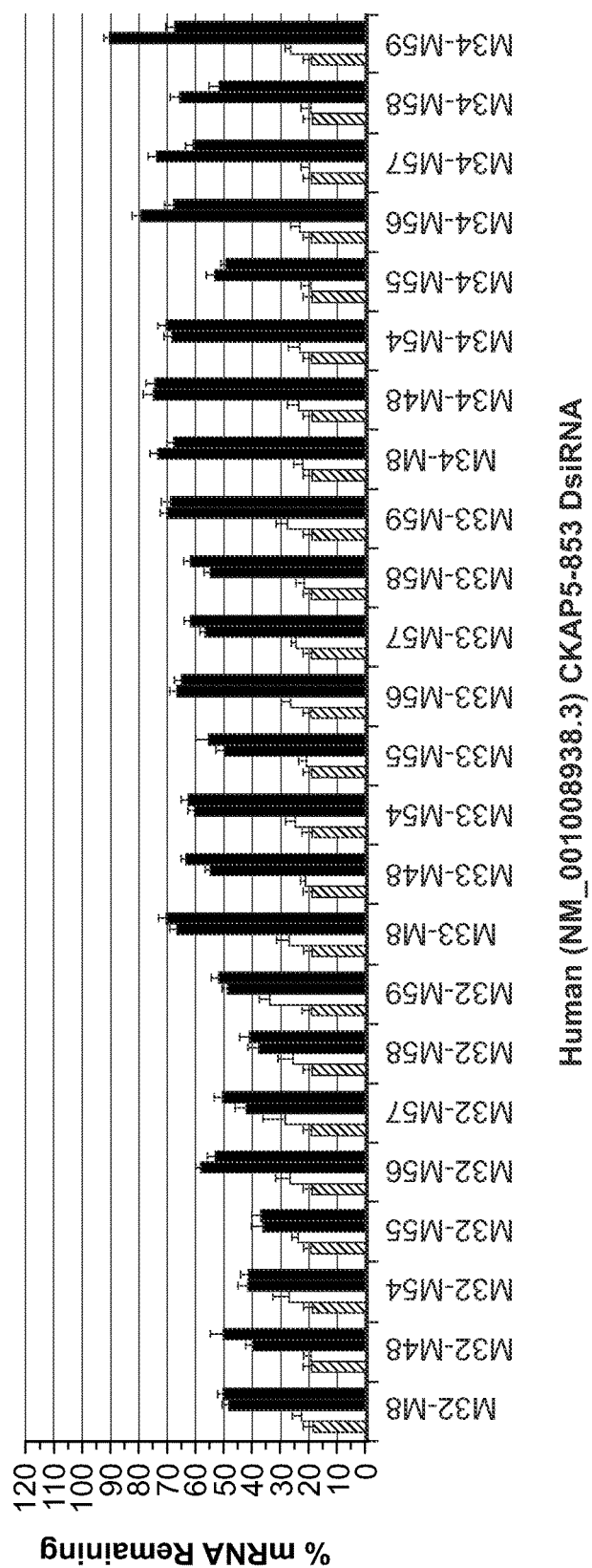
Figures 6, 7, 8, 9, 10, 11, 12, 13, 14, 15, 16, 17, 18, 18A:
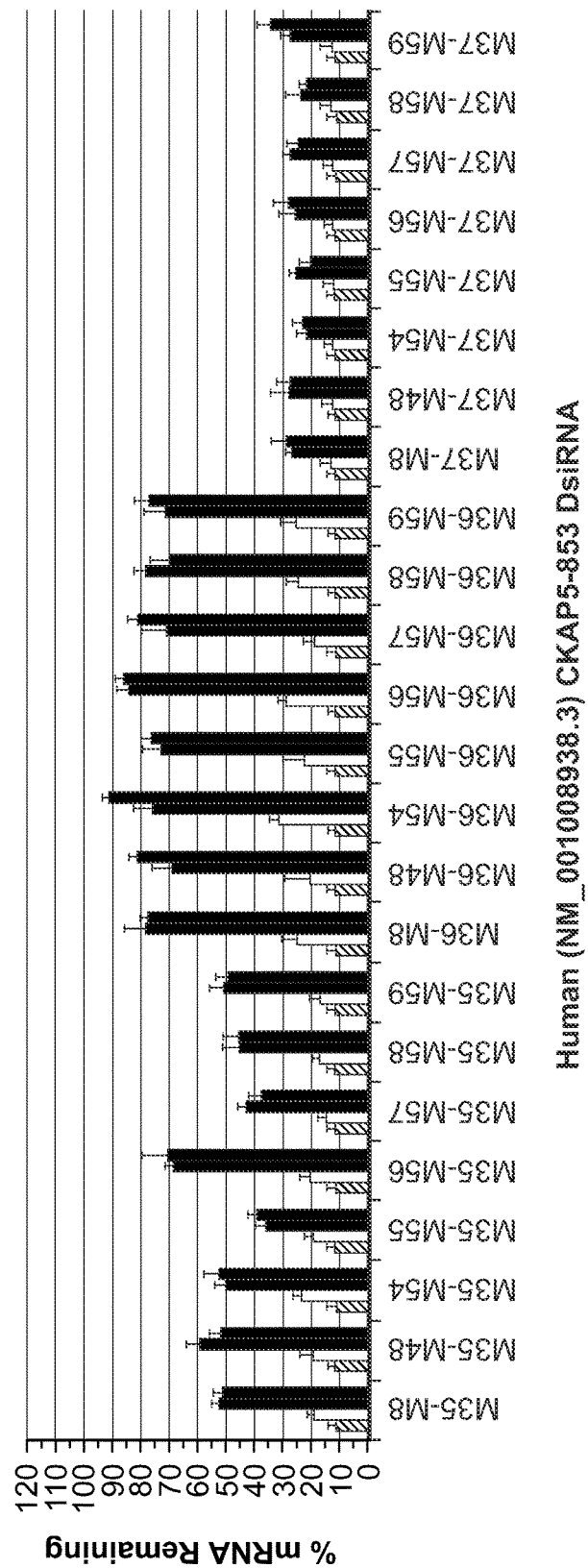
Figures 6, 7, 8, 9, 10, 11, 12, 13, 14, 15, 16, 17, 18, 18B:
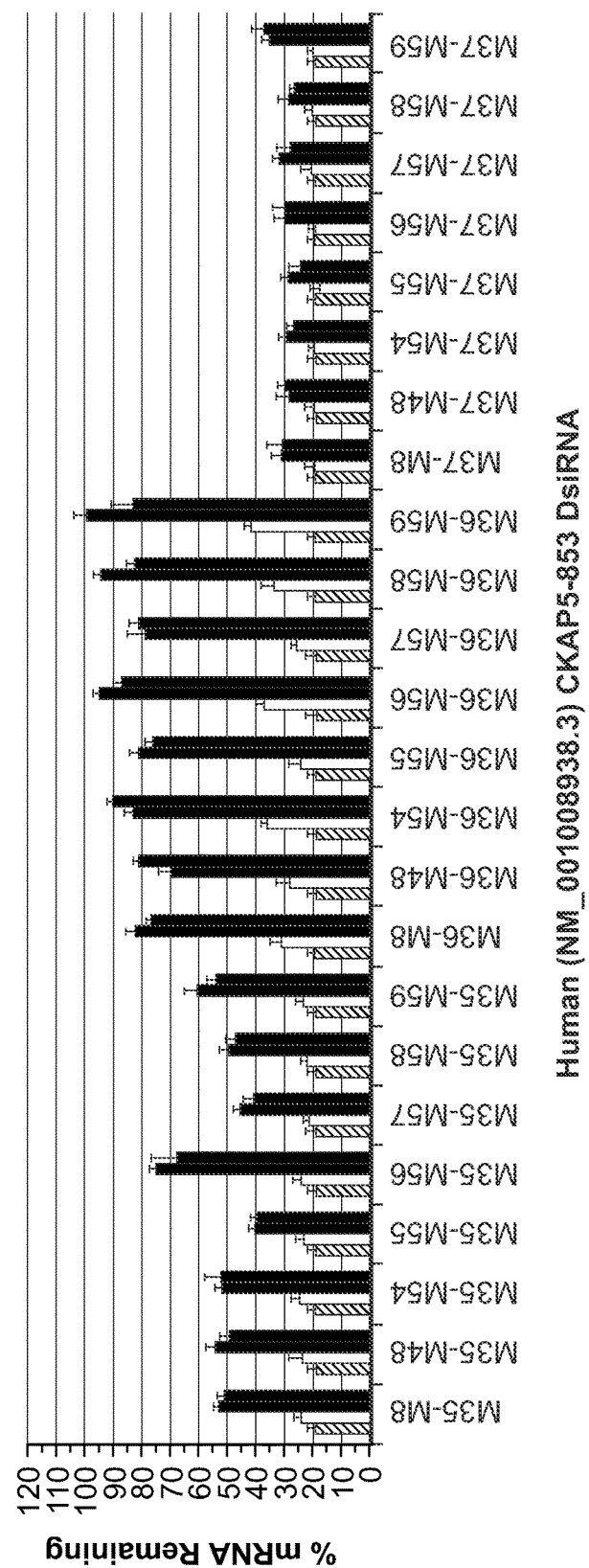
Figures 6, 7, 8, 9, 10, 11, 12, 13, 14, 15, 16, 17, 18, 19, 19A:
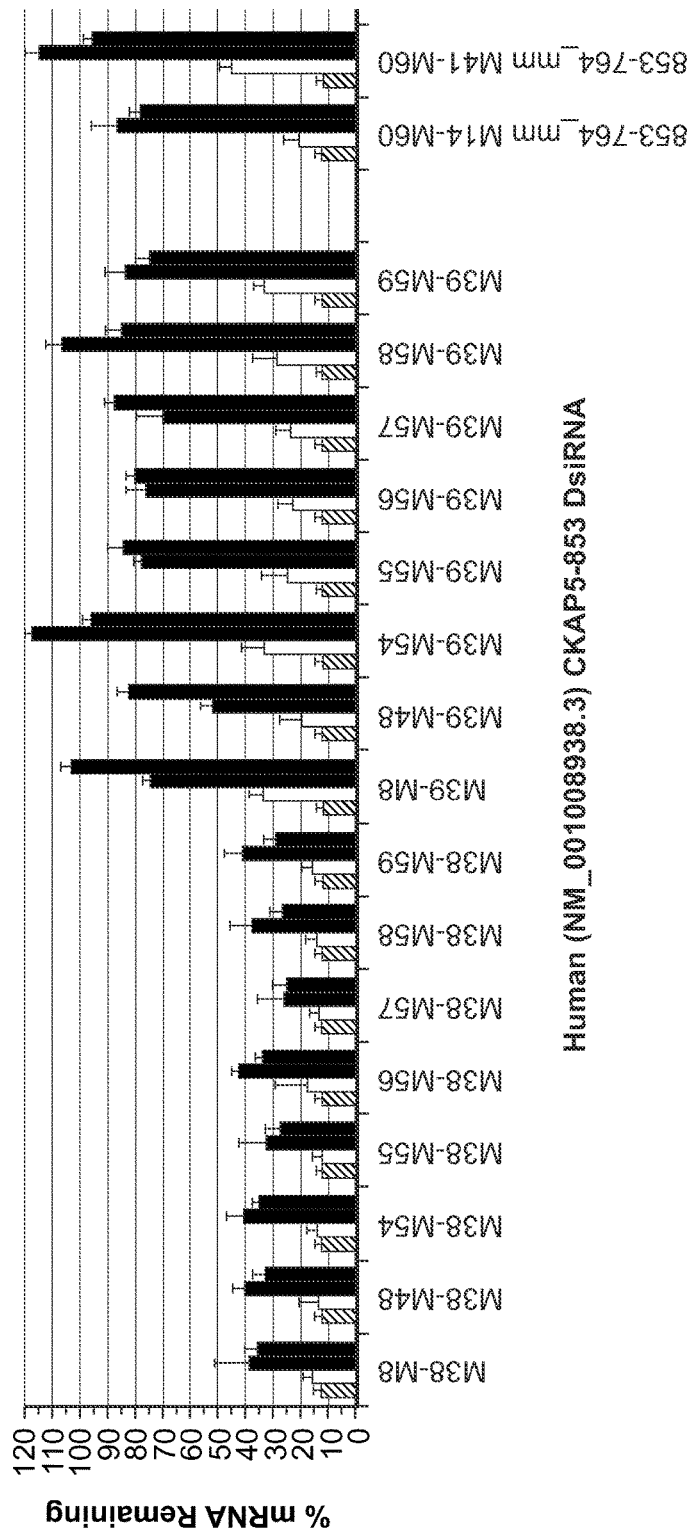
Figures 6, 7, 8, 9, 10, 11, 12, 13, 14, 15, 16, 17, 18, 19, 19B:
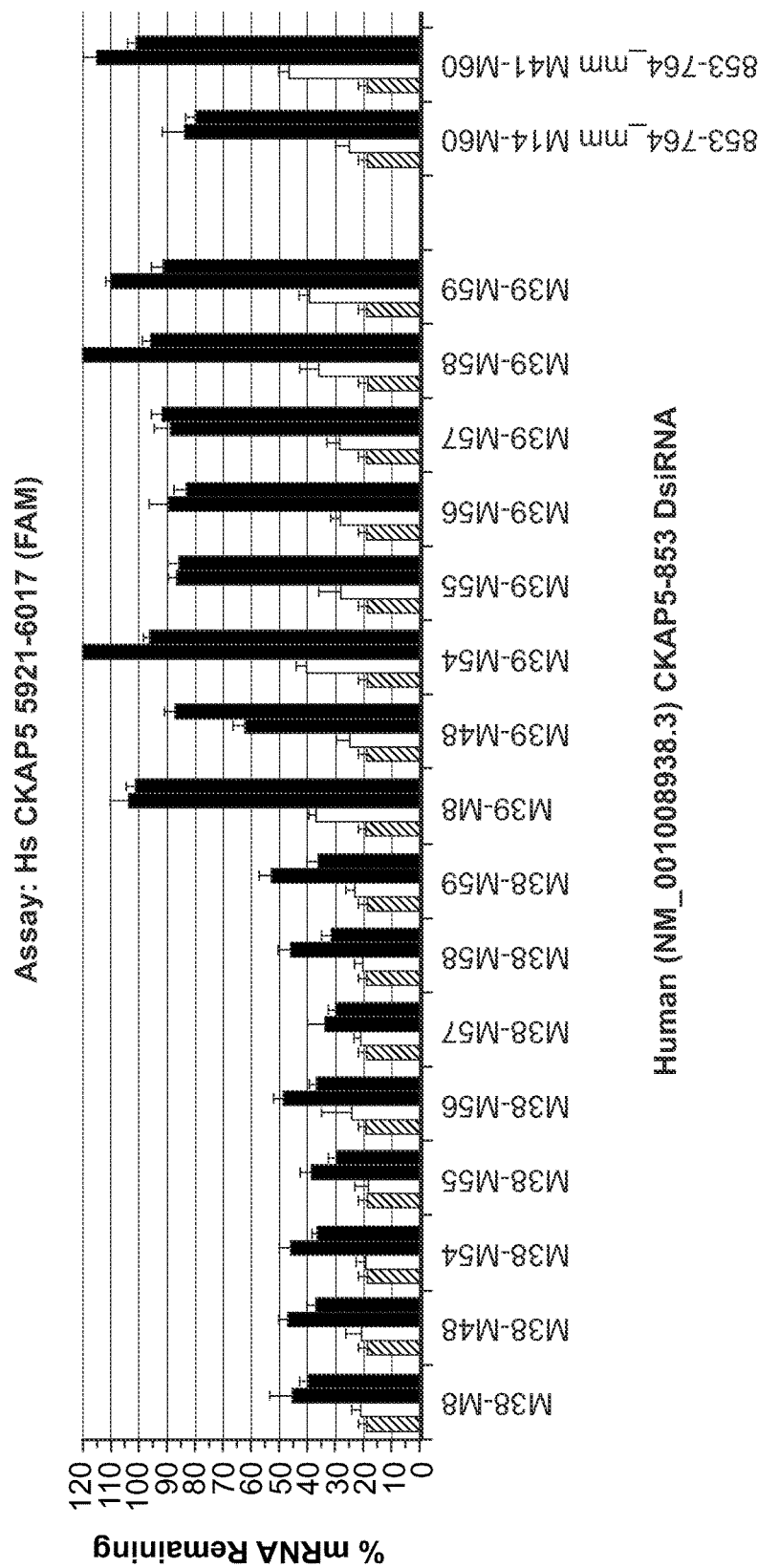
Figures 6, 7, 8, 9, 10, 11, 12, 13, 14, 15, 16, 17, 18, 19, 20, 20A:
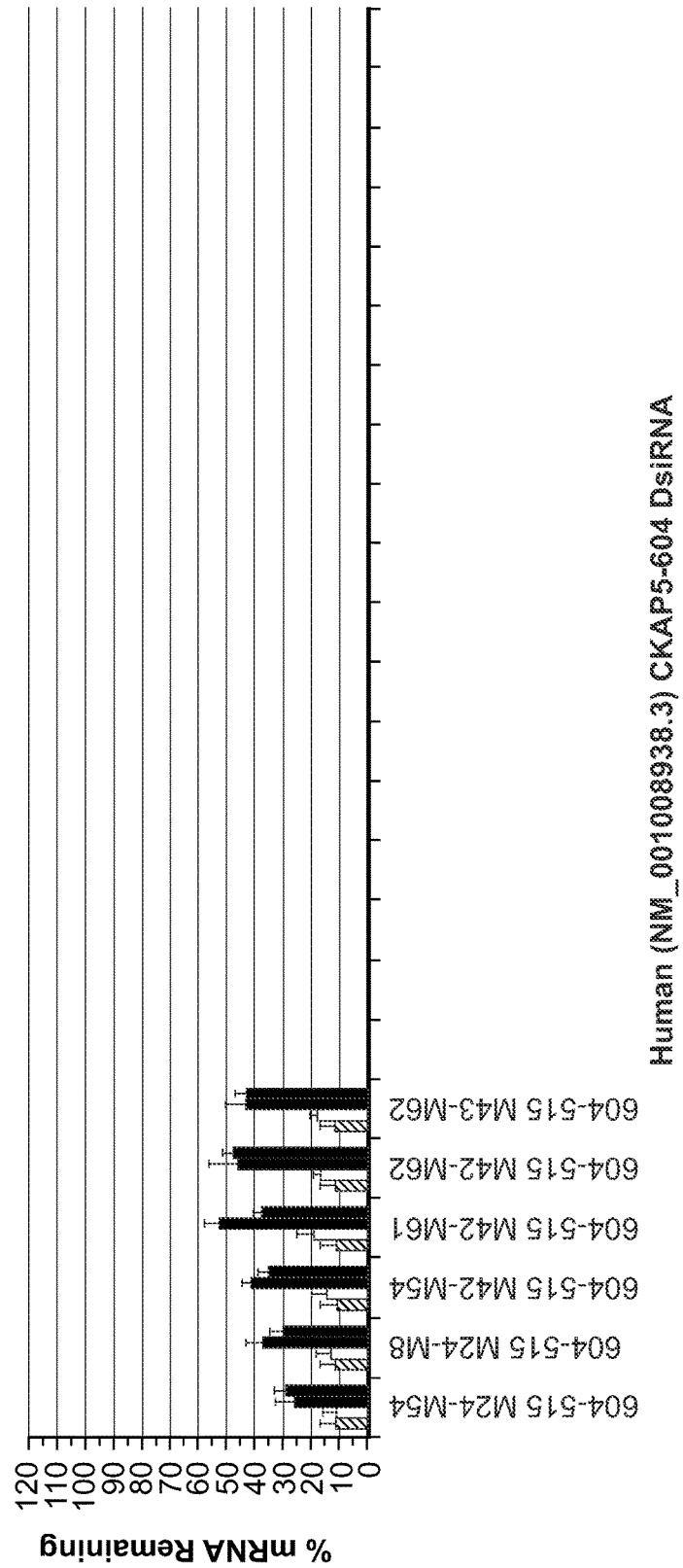

As used herein, "Dicer cleavage site" refers to the sites at which Dicer cleaves a dsRNA (e.g., the dsRNA region of a DsiRNA agent of the invention). Dicer contains two RNase III domains which typically cleave both the sense and antisense strands of a dsRNA. The average distance between the RNase III domains and the PAZ domain determines the length of the short double-stranded nucleic acid fragments it produces and this distance can vary (Macrae et al. (2006) Science 311: 195-8). As shown in FIG. 1, Dicer is projected to cleave certain double-stranded ribonucleic acids of the instant invention that possess an antisense strand having a 2 nucleotide 3' overhang at a site between the $21^{st}$ and $22^{nd}$ nucleotides removed from the 3' terminus of the antisense strand, and at a corresponding site between the $21^{st}$ and $22^{nd}$ nucleotides removed from the 5' terminus of the sense strand. The projected and/or prevalent Dicer cleavage site(s) for dsRNA molecules distinct from those depicted in FIG. 1 may be similarly identified via art-recognized methods, including those described in Macrae et al. While the Dicer cleavage events depicted in FIG. 1 generate 21 nucleotide siRNAs, it is noted that Dicer cleavage of a dsRNA (e.g., DsiRNA) can result in generation of Dicer-processed siRNA lengths of 19 to 23 nucleotides in length. Indeed, in certain embodiments, a double-stranded DNA region may be included within a dsRNA for purpose of directing prevalent Dicer excision of a typically non-preferred 19mer or 20mer siRNA, rather than a 21mer.

As used herein, "overhang" refers to unpaired nucleotides, in the context of a duplex having one or more free ends at the 5' terminus or 3' terminus of a dsRNA. In certain embodiments, the overhang is a 3' or 5' overhang on the antisense strand or sense strand. In some embodiments, the overhang is a 3' overhang having a length of between one and six nucleotides, optionally one to five, one to four, one to three, one to two, two to six, two to five, two to four, two to three, three to six, three to five, three to four, four to six, four to five, five to six nucleotides, or one, two, three, four, five or six nucleotides. "Blunt" or "blunt end" means that there are no unpaired nucleotides at that end of the dsRNA, i.e., no nucleotide overhang. For clarity, chemical caps or non-nucleotide chemical moieties conjugated to the 3' end or 5' end of an siRNA are not considered in determining whether an siRNA has an overhang or is blunt ended. In certain embodiments, the invention provides a dsRNA molecule for inhibiting the expression of the CKAP5 target gene in a cell or mammal, wherein the dsRNA comprises an antisense strand comprising a region of complementarity which is complementary to at least a part of an mRNA formed in the expression of the CKAP5 target gene, and wherein the region of complementarity is less than 35 nucleotides in length, optionally 19-24 nucleotides in length or 25-30 nucleotides in length, and wherein the dsRNA, upon contact with a cell expressing the CKAP5 target gene, inhibits the expression of the CKAP5 target gene by at least 10%, 25%, or 40%.

A dsRNA of the invention comprises two strands comprising RNA that are sufficiently complementary to hybridize to form a duplex structure. One strand of the dsRNA (the antisense strand) comprises a region of complementarity that is substantially complementary, and generally fully complementary, to a target sequence, derived from the sequence of an mRNA formed during the expression of the CKAP5 target gene, the other strand (the sense strand) comprises a region which is complementary to the antisense strand, such that the two strands hybridize and form a duplex structure when combined under suitable conditions. Generally, the duplex structure is between 15 and 35, optionally between 25 and 30, between 26 and 30, between 18 and 25, between 19 and 24, or between 19 and 21 base pairs in length. Similarly, the region of complementarity to the target sequence is between 15 and 35, optionally between 18 and 30, between 25 and 30, between 19 and 24, or between 19 and 21 nucleotides in length. The dsRNA of the invention may further comprise one or more single-stranded nucleotide overhang(s). It has been identified that dsRNAs comprising duplex structures of between 15 and 35 base pairs in length can be effective in inducing RNA interference, including DsiRNAs (generally of at least 25 base pairs in length) and siRNAs (in certain embodiments, duplex structures of siRNAs are between 20 and 23, and optionally, specifically 21 base pairs (Elbashir et al., *EMBO* 20: 6877-6888)). It has also been identified that dsRNAs possessing duplexes shorter than 20 base pairs can be effective as well (e.g., 15, 16, 17, 18 or 19 base pair duplexes). In certain embodiments, the dsRNAs of the invention can comprise at least one strand of a length of 19 nucleotides or more. In certain embodiments, it can be reasonably expected that shorter dsRNAs comprising a sequence complementary to one of the sequences of Table 4 or Table 7, minus only a few nucleotides on one or both ends may be similarly effective as compared to the dsRNAs described above and in Tables 2-3 and 5-6. Hence, dsRNAs comprising a partial sequence of at least 15, 16, 17, 18, 19, 20, or more contiguous nucleotides sufficiently complementary to one of the sequences of Table 4 or Table 7, and differing in their ability to inhibit the expression of the CKAP5 target gene in an assay as described herein by not more than 5, 10, 15, 20, 25, or 30% inhibition from a dsRNA comprising the full sequence, are contemplated by the invention. In one embodiment, at least one end of the dsRNA has a single-stranded nucleotide overhang of 1 to 5, optionally 1 to 4, in certain embodiments, 1 or 2 nucleotides. Certain dsRNA structures having at least one nucleotide overhang possess superior inhibitory properties as compared to counterparts possessing base-paired blunt ends at both ends of the dsRNA molecule.

As used herein, the term "RNA processing" refers to processing activities performed by components of the siRNA, miRNA or RNase H pathways (e.g., Drosha, Dicer, Argonaute2 or other RISC endoribonucleases, and RNaseH), which are described in greater detail below (see "RNA Processing" section below). The term is explicitly distinguished from the post-transcriptional processes of 5' capping of RNA and degradation of RNA via non-RISC- or non-RNase H-mediated processes. Such "degradation" of an RNA can take several forms, e.g. deadenylation (removal of a 3' poly(A) tail), and/or nuclease digestion of part or all of the body of the RNA by one or more of several endo- or exo-nucleases (e.g., RNase III, RNase P, RNase T1, RNase A (1, 2, 3, 4/5), oligonucleotidase, etc.).

By "homologous sequence" is meant a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.). Indeed, design and use of the dsRNA agents of the instant invention contemplates the possibility of using such dsRNA agents not only against target RNAs of CKAP5 possessing perfect complementarity with the presently described dsRNA agents, but also against target CKAP5 RNAs possessing sequences that are, e.g., only 99%, 98%, 97%, 96%, 95%, 94%, 93%, 92%, 91%, 90%, 89%, 88%, 87%, 86%, 85%, 84%, 83%, 82%, 81%, 80% etc. complementary to said dsRNA agents. Similarly, it is contemplated that the presently described dsRNA agents of the instant invention might be readily altered by the skilled artisan to enhance the extent of complementarity between said dsRNA agents and a target CKAP5 RNA, e.g., of a specific allelic variant of CKAP5 (e.g., an allele of enhanced therapeutic interest). Indeed, dsRNA agent sequences with insertions, deletions, and single point mutations relative to the target CKAP5 sequence can also be effective for inhibition. Alternatively, dsRNA agent sequences with nucleotide analog substitutions or insertions can be effective for inhibition.

Sequence identity may be determined by sequence comparison and alignment algorithms known in the art. To determine the percent identity of two nucleic acid sequences (or of two amino acid sequences), the sequences are aligned for comparison purposes (e.g., gaps can be introduced in the first sequence or second sequence for optimal alignment). The nucleotides (or amino acid residues) at corresponding nucleotide (or amino acid) positions are then compared. When a position in the first sequence is occupied by the same residue as the corresponding position in the second sequence, then the molecules are identical at that position. The percent identity between the two sequences is a function of the number of identical positions shared by the sequences (i.e., % homology=# of identical positions/total # of positions×100), optionally penalizing the score for the number of gaps introduced and/or length of gaps introduced.

The comparison of sequences and determination of percent identity between two sequences can be accomplished using a mathematical algorithm. In one embodiment, the alignment generated over a certain portion of the sequence aligned having sufficient identity but not over portions having low degree of identity (i.e., a local alignment). A preferred, non-limiting example of a local alignment algorithm utilized for the comparison of sequences is the algorithm of Karlin and Altschul (1990) *Proc. Natl. Acad. Sci. USA* 87:2264-68, modified as in Karlin and Altschul (1993) *Proc. Natl. Acad. Sci. USA* 90:5873-77. Such an algorithm is incorporated into the BLAST programs (version 2.0) of Altschul, et al. (1990) *J. Mol. Biol.* 215:403-10.

In another embodiment, a gapped alignment the alignment is optimized is formed by introducing appropriate gaps, and percent identity is determined over the length of the aligned sequences (i.e., a gapped alignment). To obtain gapped alignments for comparison purposes, Gapped BLAST can be utilized as described in Altschul et al., (1997) Nucleic Acids Res. 25(17):3389-3402. In another embodiment, a global alignment the alignment is optimized is formed by introducing appropriate gaps, and percent identity is determined over the entire length of the sequences aligned. (i.e., a global alignment). A preferred, non-limiting example of a mathematical algorithm utilized for the global comparison of sequences is the algorithm of Myers and Miller, CABIOS (1989). Such an algorithm is incorporated into the ALIGN program (version 2.0) which is part of the GCG sequence alignment software package. When utilizing the ALIGN program for comparing amino acid sequences, a PAM120 weight residue table, a gap length penalty of 12, and a gap penalty of 4 can be used.

Greater than 80% sequence identity, e.g., 80%, 81%, 82%, 83%, 84%, 85%, 86%, 87%, 88%, 89%, 90%, 91%, 92%, 93%, 94%, 95%, 96%, 97%, 98%, 99% or even 100% sequence identity, between the dsRNA antisense strand and the portion of the CKAP5 RNA sequence is preferred. Alternatively, the dsRNA may be defined functionally as a nucleotide sequence (or oligonucleotide sequence) that is capable of hybridizing with a portion of the CKAP5 RNA (e.g., 400 mM NaCl, 40 mM PIPES pH 6.4, 1 mM EDTA, 50° C. or 70° C. hybridization for 12-16 hours; followed by washing). Additional preferred hybridization conditions include hybridization at 70° C. in 1×SSC or 50° C. in 1×SSC, 50% formamide followed by washing at 70° C. in 0.3×SSC or hybridization at 70° C. in 4×SSC or 50° C. in 4×SSC, 50% formamide followed by washing at 67° C. in 1×SSC. The hybridization temperature for hybrids anticipated to be less than 50 base pairs in length should be 5-10° C. less than the melting temperature (Tm) of the hybrid, where Tm is determined according to the following equations. For hybrids less than 18 base pairs in length, Tm(° C.)=2(# of A+T bases)+4(# of G+C bases). For hybrids between 18 and 49 base pairs in length, Tm(° C.)=81.5+16.6(log 10[Na+])+0.41 (% G+C)−(600/N), where N is the number of bases in the hybrid, and [Na+] is the concentration of sodium ions in the hybridization buffer ([Na+] for 1×SSC=0.165 M). Additional examples of stringency conditions for polynucleotide hybridization are provided in Sambrook, J., E. F. Fritsch, and T. Maniatis, 1989, Molecular Cloning: A Laboratory Manual, Cold Spring Harbor Laboratory Press, Cold Spring Harbor, N.Y., chapters 9 and 11, and Current Protocols in Molecular Biology, 1995, F. M. Ausubel et al., eds., John Wiley & Sons, Inc., sections 2.10 and 6.3-6.4. The length of the identical nucleotide sequences may be at least 10, 12, 15, 17, 20, 22, 25, 27 or 30 bases.

By "conserved sequence region" is meant, a nucleotide sequence of one or more regions in a polynucleotide does not vary significantly between generations or from one biological system, subject, or organism to another biological system, subject, or organism. The polynucleotide can include both coding and non-coding DNA and RNA.

By "sense region" is meant a nucleotide sequence of a dsRNA molecule having complementarity to an antisense region of the dsRNA molecule. In addition, the sense region of a dsRNA molecule can comprise a nucleic acid sequence having homology with a target nucleic acid sequence.

By "antisense region" is meant a nucleotide sequence of a dsRNA molecule having complementarity to a target nucleic acid sequence. In addition, the antisense region of a dsRNA molecule comprises a nucleic acid sequence having complementarity to a sense region of the dsRNA molecule.

As used herein, "antisense strand" refers to a single stranded nucleic acid molecule which has a sequence complementary to that of a target RNA. When the antisense strand contains modified nucleotides with base analogs, it is not necessarily complementary over its entire length, but must at least hybridize with a target RNA.

As used herein, "sense strand" refers to a single stranded nucleic acid molecule which has a sequence complementary to that of an antisense strand. When the antisense strand contains modified nucleotides with base analogs, the sense strand need not be complementary over the entire length of the antisense strand, but must at least duplex with the antisense strand.

As used herein, "guide strand" refers to a single stranded nucleic acid molecule of a dsRNA or dsRNA-containing molecule, which has a sequence sufficiently complementary to that of a target RNA to result in RNA interference. After cleavage of the dsRNA or dsRNA-containing molecule by Dicer, a fragment of the guide strand remains associated with RISC, binds a target RNA as a component of the RISC complex, and promotes cleavage of a target RNA by RISC. As used herein, the guide strand does not necessarily refer to a continuous single stranded nucleic acid and may comprise a discontinuity, preferably at a site that is cleaved by Dicer. A guide strand is an antisense strand.

As used herein, "passenger strand" refers to an oligonucleotide strand of a dsRNA or dsRNA-containing molecule, which has a sequence that is complementary to that of the guide strand. As used herein, the passenger strand does not necessarily refer to a continuous single stranded nucleic acid and may comprise a discontinuity, preferably at a site that is cleaved by Dicer. A passenger strand is a sense strand.

By "target nucleic acid" is meant a nucleic acid sequence whose expression, level or activity is to be modulated. The target nucleic acid can be DNA or RNA. For agents that target CKAP5, in certain embodiments, the target nucleic acid is CKAP5 RNA, e.g., in certain embodiments, CKAP5 mRNA. CKAP5 RNA target sites can also interchangeably be referenced by corresponding cDNA sequences. Levels of CKAP5 may also be targeted via targeting of upstream effectors of CKAP5, or the effects of modulated or misregulated CKAP5 may also be modulated by targeting of molecules downstream of CKAP5 in the CKAP5 signalling pathway.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, CSH Symp. Quant. Biol. LII pp. 123-133; Frier et al., 1986, Proc. Nat. Acad. Sci. USA 83:9373-9377; Turner et al., 1987, J. Am. Chem. Soc. 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence. In one embodiment, a dsRNA molecule of the invention comprises 19 to 30 (e.g., 19, 20, 21, 22, 23, 24, 25, 26, 27, 28, 29, or 30 or more) nucleotides that are complementary to one or more target nucleic acid molecules or a portion thereof.

In one embodiment, dsRNA molecules of the invention that down regulate or reduce CKAP5 gene expression are used for treating, preventing or reducing CKAP5-related diseases or disorders (e.g., cancer) in a subject or organism.

In one embodiment of the present invention, each sequence of a DsiRNA molecule of the invention is independently 25 to 35 nucleotides in length, in specific embodiments 25, 26, 27, 28, 29, 30, 31, 32, 33, 34 or 35 nucleotides in length. In another embodiment, the DsiRNA duplexes of the invention independently comprise 25 to 30 base pairs (e.g., 25, 26, 27, 28, 29, or 30). In another embodiment, one or more strands of the DsiRNA molecule of the invention independently comprises 19 to 35 nucleotides (e.g., 19, 20, 21, 22, 23, 24, 25, 26, 27, 28, 29, 30, 31, 32, 33, 34 or 35) that are complementary to a target (CKAP5) nucleic acid molecule. In certain embodiments, a DsiRNA molecule of the invention possesses a length of duplexed nucleotides between 25 and 34 nucleotides in length (e.g., 25, 26, 27, 28, 29, 30, 31, 32, 33 or 34 nucleotides in length; optionally, all such nucleotides base pair with cognate nucleotides of the opposite strand). (Exemplary DsiRNA molecules of the invention are shown in FIG. 1, and below.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell. Within certain aspects, the term "cell" refers specifically to mammalian cells, such as human cells, that contain one or more isolated dsRNA molecules of the present disclosure. In particular aspects, a cell processes dsRNAs or dsRNA-containing molecules resulting in RNA interference of target nucleic acids, and contains proteins and protein complexes required for RNAi, e.g., Dicer and RISC.

In certain embodiments, dsRNAs of the invention are Dicer substrate siRNAs ("DsiRNAs"). DsiRNAs can possess certain advantages as compared to inhibitory nucleic acids that are not dicer substrates ("non-DsiRNAs"). Such advantages include, but are not limited to, enhanced duration of effect of a DsiRNA relative to a non-DsiRNA, as well as enhanced inhibitory activity of a DsiRNA as compared to a non-DsiRNA (e.g., a 19-23mer siRNA) when each inhibitory nucleic acid is suitably formulated and assessed for inhibitory activity in a mammalian cell at the same concentration (in this latter scenario, the DsiRNA would be identified as more potent than the non-DsiRNA). Detection of the enhanced potency of a DsiRNA relative to a non-DsiRNA is often most readily achieved at a formulated concentration (e.g., transfection concentration of the dsRNA) that results in the DsiRNA eliciting approximately 30-70% knockdown activity upon a target RNA (e.g., a mRNA). For active DsiRNAs, such levels of knockdown activity are most often achieved at in vitro mammalian cell DsiRNA transfection concentrations of 1 nM or less of as suitably formulated, and in certain instances are observed at DsiRNA transfection concentrations of 200 pM or less, 100 pM or less, 50 pM or less, 20 pM or less, 10 pM or less, 5 pM or less, or even 1 pM or less. Indeed, due to the variability among DsiRNAs of the precise concentration at which 30-70% knockdown of a target RNA is observed, construction of an $IC_{50}$ curve via assessment of the inhibitory activity of DsiRNAs and non-DsiRNAs across a range of effective concentrations is a preferred method for detecting the enhanced potency of a DsiRNA relative to a non-DsiRNA inhibitory agent.

In certain embodiments, a DsiRNA (in a state as initially formed, prior to dicer cleavage) is more potent at reducing CKAP5 target gene expression in a mammalian cell than a 19, 20, 21, 22 or 23 base pair sequence that is contained within it. In certain such embodiments, a DsiRNA prior to dicer cleavage is more potent than a 19-21mer contained within it. Optionally, a DsiRNA prior to dicer cleavage is more potent than a 19 base pair duplex contained within it that is synthesized with symmetric dTdT overhangs (thereby forming a siRNA possessing 21 nucleotide strand lengths having dTdT overhangs). In certain embodiments, the DsiRNA is more potent than a 19-23mer siRNA (e.g., a 19 base pair duplex with dTdT overhangs) that targets at least 19 nucleotides of the 21 nucleotide target sequence that is recited for a DsiRNA of the invention (without wishing to be bound by theory, the identity of a such a target site for a DsiRNA is identified via identification of the Ago2 cleavage site for the DsiRNA; once the Ago2 cleavage site of a DsiRNA is determined for a DsiRNA, identification of the Ago2 cleavage site for any other inhibitory dsRNA can be performed and these Ago2 cleavage sites can be aligned, thereby determining the alignment of projected target nucleotide sequences for multiple dsRNAs). In certain related embodiments, the DsiRNA is more potent than a 19-23mer siRNA that targets at least 20 nucleotides of the 21 nucleotide target sequence that is recited for a DsiRNA of the invention. Optionally, the DsiRNA is more potent than a 19-23mer siRNA that targets the same 21 nucleotide target sequence that is recited for a DsiRNA of the invention. In certain embodiments, the DsiRNA is more potent than any 21mer siRNA that targets the same 21 nucleotide target sequence that is recited for a DsiRNA of the invention.

Optionally, the DsiRNA is more potent than any 21 or 22mer siRNA that targets the same 21 nucleotide target sequence that is recited for a DsiRNA of the invention. In certain embodiments, the DsiRNA is more potent than any 21, 22 or 23mer siRNA that targets the same 21 nucleotide target sequence that is recited for a DsiRNA of the invention. As noted above, such potency assessments are most effectively performed upon dsRNAs that are suitably formulated (e.g., formulated with an appropriate transfection reagent) at a concentration of 1 nM or less. Optionally, an $IC_{50}$ assessment is performed to evaluate activity across a range of effective inhibitory concentrations, thereby allowing for robust comparison of the relative potencies of dsRNAs so assayed.

The dsRNA molecules of the invention are added directly, or can be complexed with lipids (e.g., cationic lipids), packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in FIG. 1, and the below exemplary structures. Examples of such nucleic acid molecules consist essentially of sequences defined in these figures and exemplary structures. Furthermore, where such agents are modified in accordance with the below description of modification patterning of DsiRNA agents, chemically modified forms of constructs described in FIG. 1, and the below exemplary structures can be used in all uses described for the DsiRNA agents of FIG. 1, and the below exemplary structures.

In another aspect, the invention provides mammalian cells containing one or more dsRNA molecules of this invention. The one or more dsRNA molecules can independently be targeted to the same or different sites.

By "RNA" is meant a molecule comprising at least one, and preferably at least 4, 8 and 12 ribonucleotide residues. The at least 4, 8 or 12 RNA residues may be contiguous. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the dsRNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the dsRNA agents of the invention can be administered. A subject can be a mammal or mammalian cells, including a human or human cells.

The phrase "pharmaceutically acceptable carrier" refers to a carrier for the administration of a therapeutic agent. Exemplary carriers include saline, buffered saline, dextrose, water, glycerol, ethanol, and combinations thereof. For drugs administered orally, pharmaceutically acceptable carriers include, but are not limited to pharmaceutically acceptable excipients such as inert diluents, disintegrating agents, binding agents, lubricating agents, sweetening agents, flavoring agents, coloring agents and preservatives. Suitable inert diluents include sodium and calcium carbonate, sodium and calcium phosphate, and lactose, while corn starch and alginic acid are suitable disintegrating agents. Binding agents may include starch and gelatin, while the lubricating agent, if present, will generally be magnesium stearate, stearic acid or talc. If desired, the tablets may be coated with a material such as glyceryl monostearate or glyceryl distearate, to delay absorption in the gastrointestinal tract. The pharmaceutically acceptable carrier of the disclosed dsRNA compositions may be micellar structures, such as a liposomes, capsids, capsoids, polymeric nanocapsules, or polymeric microcapsules.

Polymeric nanocapsules or microcapsules facilitate transport and release of the encapsulated or bound dsRNA into the cell. They include polymeric and monomeric materials, especially including polybutylcyanoacrylate. A summary of materials and fabrication methods has been published (see Kreuter, 1991). The polymeric materials which are formed from monomeric and/or oligomeric precursors in the polymerization/nanoparticle generation step, are per se known from the prior art, as are the molecular weights and molecular weight distribution of the polymeric material which a person skilled in the field of manufacturing nanoparticles may suitably select in accordance with the usual skill.

Various methodologies of the instant invention include step that involves comparing a value, level, feature, characteristic, property, etc. to a "suitable control", referred to interchangeably herein as an "appropriate control". A "suitable control" or "appropriate control" is a control or standard familiar to one of ordinary skill in the art useful for comparison purposes. In one embodiment, a "suitable control" or "appropriate control" is a value, level, feature, characteristic, property, etc. determined prior to performing an RNAi methodology, as described herein. For example, a transcription rate, mRNA level, translation rate, protein level, biological activity, cellular characteristic or property, genotype, phenotype, etc. can be determined prior to introducing an RNA silencing agent (e.g., DsiRNA) of the invention into a cell or organism. In another embodiment, a "suitable control" or "appropriate control" is a value, level, feature, characteristic, property, etc. determined in a cell or organism, e.g., a control or normal cell or organism, exhibiting, for example, normal traits. In yet another embodiment, a "suitable control" or "appropriate control" is a predefined value, level, feature, characteristic, property, etc.

The term "in vitro" has its art recognized meaning, e.g., involving purified reagents or extracts, e.g., cell extracts. The term "in vivo" also has its art recognized meaning, e.g., involving living cells, e.g., immortalized cells, primary cells, cell lines, and/or cells in an organism.

"Treatment", or "treating" as used herein, is defined as the application or administration of a therapeutic agent (e.g., a dsRNA agent or a vector or transgene encoding same) to a patient, or application or administration of a therapeutic agent to an isolated tissue or cell line from a patient, who has a disorder with the purpose to cure, heal, alleviate, relieve, alter, remedy, ameliorate, improve or affect the disease or disorder, or symptoms of the disease or disorder. The term "treatment" or "treating" is also used herein in the context of administering agents prophylactically. The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. The term "patient" includes human and other mammalian subjects that receive either prophylactic or therapeutic treatment.

Structures of Anti-CKAP5 DsiRNA Agents

In certain embodiments, the anti-CKAP5 DsiRNA agents of the invention can have the following structures:

In one such embodiment, the DsiRNA comprises:

5'-XXXXXXXXXXXXXXXXXXXXXXXXX-3'

3'-YXXXXXXXXXXXXXXXXXXXXXXXXX-5' wherein "X"=RNA and "Y" is an overhang domain comprised of 1-4 RNA monomers that are optionally 2'-O-methyl RNA monomers. In a related embodiment, the DsiRNA comprises:

5'-XXXXXXXXXXXXXXXXXXXXXXXDD-3'

3'-YXXXXXXXXXXXXXXXXXXXXXXXXX-5' wherein "X"=RNA, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand.

DsiRNAs of the invention can carry a broad range of modification patterns (e.g., 2'-O-methyl RNA patterns, e.g., within extended DsiRNA agents). Certain modification patterns of the second strand of DsiRNAs of the invention are presented below.

In one embodiment, the DsiRNA comprises:

5'-XXXXXXXXXXXXXXXXXXXXXXXXX-3'

3'-Y<u>XXXXXXXXXXXXXX</u>XXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

5'-XXXXXXXXXXXXXXXXXXXXXXXDD-3'

3'-Y<u>XXXXXXXXXXXXXX</u>XXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers, and "D"=DNA. The top strand is the sense strand, and the bottom strand is the antisense strand.

In another such embodiment, the DsiRNA comprises:

5'-XXXXXXXXXXXXXXXXXXXXXXXXX-3'

3'-Y<u>XXXXXXXXXXXXXX</u>XXXXXXXXXXX-5' wherein "X"=RNA, "<u>X</u>"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In another such embodiment, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M7" or "M7" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X̲"=2'-O-methyl RNA, and "D"=DNA. The top strand is the sense strand, and the bottom strand is the antisense strand. This modification pattern is also referred to herein as the "AS-M6" or "M6" modification pattern.

In other embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

wherein "X"=RNA and "X"=2'-O-methyl RNA. The top strand is the sense strand, and the bottom strand is the antisense strand. In another related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M5" or "M5" modification pattern.

In further embodiments, the DsiRNA comprises:

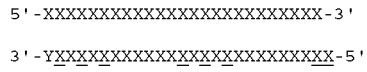

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

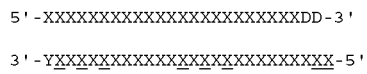

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In one related embodiment, the DsiRNA comprises:

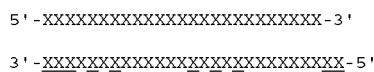

wherein "X"=RNA and "X"=2'-O-methyl RNA. The top strand is the sense strand, and the bottom strand is the antisense strand. In a further related embodiment, the DsiRNA comprises:

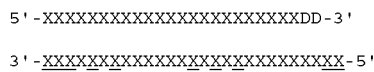

wherein "X"=RNA, "X"=2'-O-methyl RNA, and "D"=DNA. The top strand is the sense strand, and the bottom strand is the antisense strand. This modification pattern is also referred to herein as the "AS-M4" or "M4" modification pattern.

In additional embodiments, the DsiRNA comprises:

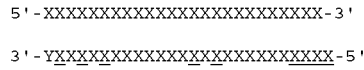

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

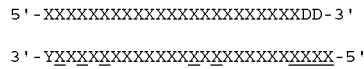

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

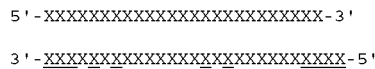

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M8" or "M8" modification pattern.

In other embodiments, the DsiRNA comprises:

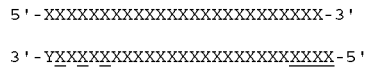

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

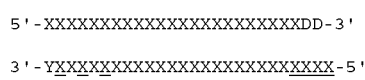

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

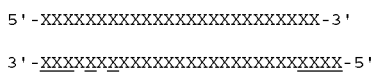

wherein "X"=RNA and "X"=2'-O-methyl RNA. The top strand is the sense strand, and the bottom strand is the antisense strand. In a further related embodiment, the DsiRNA comprises:

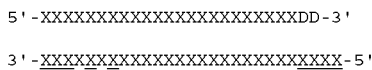

wherein "X"=RNA, "X"=2'-O-methyl RNA, and "D"=DNA. The top strand is the sense strand, and the bottom strand is the antisense strand. This modification pattern is also referred to herein as the "AS-M3" or "M3" modification pattern.

In additional embodiments, the DsiRNA comprises:

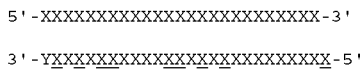

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

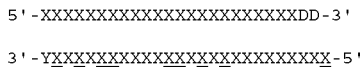

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

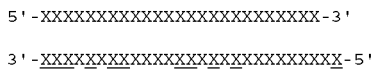

wherein "X"=RNA and "X"=2'-O-methyl RNA. The top strand is the sense strand, and the bottom strand is the antisense strand. In a further related embodiment, the DsiRNA comprises:

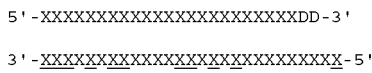

wherein "X"=RNA, "X"=2'-O-methyl RNA, and "D"=DNA. The top strand is the sense strand, and the bottom strand is the antisense strand. This modification pattern is also referred to herein as the "AS-M2" or "M2" modification pattern.

In further embodiments, the DsiRNA comprises:

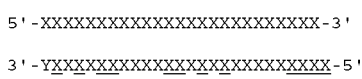

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

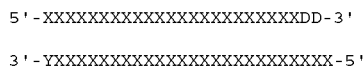

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

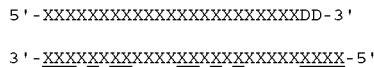

wherein "X"=RNA, "X"=2'-O-methyl RNA, and "D"=DNA. The top strand is the sense strand, and the bottom strand is the antisense strand. This modification pattern is also referred to herein as the "AS-M1" or "M1" modification pattern.

In additional embodiments, the DsiRNA comprises:

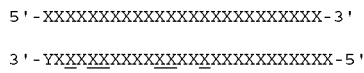

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

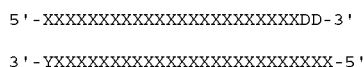

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

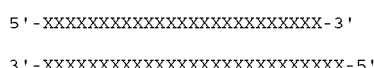

wherein "X"=RNA and "X"=2'-O-methyl RNA. The top strand is the sense strand, and the bottom strand is the antisense strand. In a further related embodiment, the DsiRNA comprises:

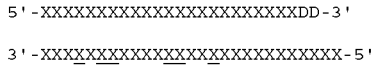

wherein "X"=RNA, "X"=2'-O-methyl RNA, and "D"=DNA. The top strand is the sense strand, and the bottom strand is the antisense strand. This modification pattern is also referred to herein as the "AS-M9" or "M9" modification pattern.

In other embodiments, the DsiRNA comprises:

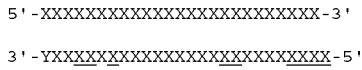

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

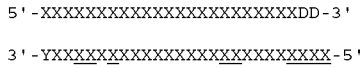

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

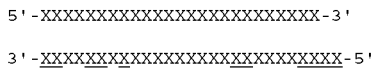

wherein "X"=RNA and "X"=2'-O-methyl RNA. The top strand is the sense strand, and the bottom strand is the antisense strand. In a further related embodiment, the DsiRNA comprises:

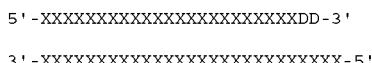

wherein "X"=RNA, "X"=2'-O-methyl RNA, and "D"=DNA. The top strand is the sense strand, and the bottom strand is the antisense strand. This modification pattern is also referred to herein as the "AS-M10" or "M10" modification pattern.

In further embodiments, the DsiRNA comprises:

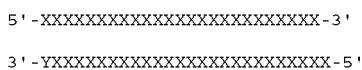

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

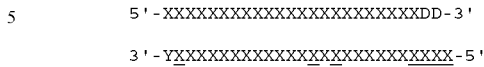

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

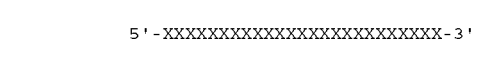

wherein "X"=RNA and "X"=2'-O-methyl RNA. The top strand is the sense strand, and the bottom strand is the antisense strand. In a further related embodiment, the DsiRNA comprises:

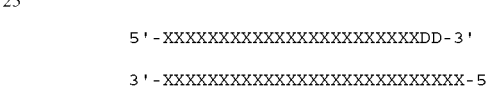

wherein "X"=RNA, "X"=2'-O-methyl RNA, and "D"=DNA. The top strand is the sense strand, and the bottom strand is the antisense strand. This modification pattern is also referred to herein as the "AS-M11" or "M11" modification pattern.

In additional embodiments, the DsiRNA comprises:

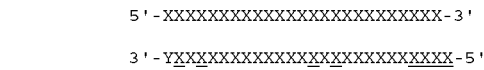

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

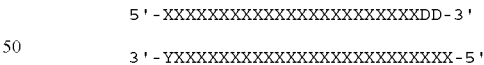

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

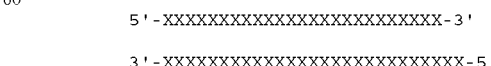

wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M12" or "M12" modification pattern.

In further embodiments, the DsiRNA comprises:

```
5'-XXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13" or "M13" modification pattern.

In other embodiments, the DsiRNA comprises:

```
5'-XXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In another related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M21" or "M21" modification pattern.

In further embodiments, the DsiRNA comprises:

```
5'-XXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14" or "M14" modification pattern.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

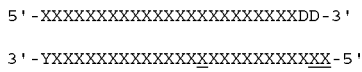

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

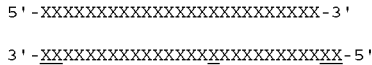

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M15" or "M15" modification pattern.

In further embodiments, the DsiRNA comprises:

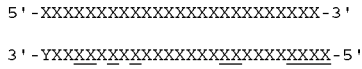

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In a related embodiment, the DsiRNA comprises:

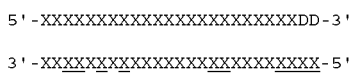

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

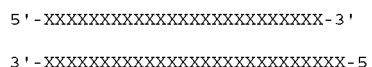

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M16" or "M16" modification pattern.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

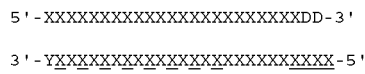

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

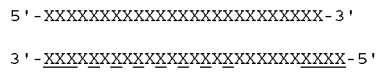

wherein "X"=RNA and "X"=2'-O-methyl RNA. The top strand is the sense strand, and the bottom strand is the antisense strand. In a further related embodiment, the DsiRNA comprises:

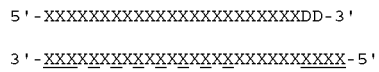

wherein "X"=RNA, "X"=2'-O-methyl RNA, and "D"=DNA. The top strand is the sense strand, and the bottom strand is the antisense strand. This modification pattern is also referred to herein as the "AS-M17" or "M17" modification pattern.

In further embodiments, the DsiRNA comprises:

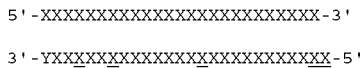

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

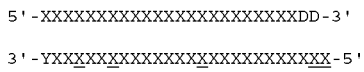

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

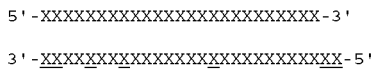

wherein "X"=RNA and "X"=2'-O-methyl RNA. The top strand is the sense strand, and the bottom strand is the antisense strand. In a further related embodiment, the DsiRNA comprises:

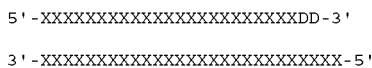

wherein "X"=RNA, "X"=2'-O-methyl RNA, and "D"=DNA. The top strand is the sense strand, and the bottom strand is the antisense strand. This modification pattern is also referred to herein as the "AS-M18" or "M18" modification pattern.

In additional embodiments, the DsiRNA comprises:

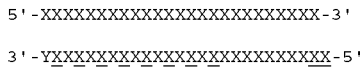

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

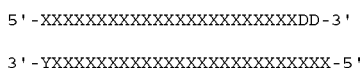

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

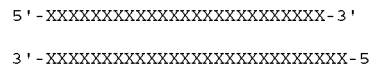

wherein "X"=RNA and "X"=2'-O-methyl RNA. The top strand is the sense strand, and the bottom strand is the antisense strand. In a further related embodiment, the DsiRNA comprises:

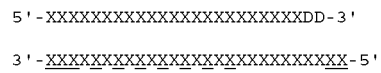

wherein "X"=RNA, "X"=2'-O-methyl RNA, and "D"=DNA. The top strand is the sense strand, and the bottom strand is the antisense strand. This modification pattern is also referred to herein as the "AS-M19" or "M19" modification pattern.

In further embodiments, the DsiRNA comprises:

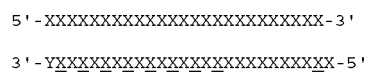

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

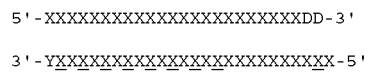

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

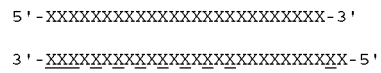

wherein "X"=RNA and "X"=2'-O-methyl RNA. The top strand is the sense strand, and the bottom strand is the antisense strand. In a further related embodiment, the DsiRNA comprises:

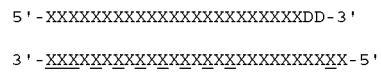

wherein "X"=RNA, "X"=2'-O-methyl RNA, and "D"=DNA. The top strand is the sense strand, and the bottom strand is the antisense strand. This modification pattern is also referred to herein as the "AS-M20" or "M20" modification pattern.

In additional embodiments, the DsiRNA comprises:

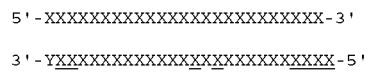

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M22" or "M22" modification pattern.

In further embodiments, the DsiRNA comprises:

```
5'-XXXXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M24" or "M24" modification pattern.

In additional embodiments, the DsiRNA comprises:

```
5'-XXXXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M25" or "M25" modification pattern.

In further embodiments, the DsiRNA comprises:

```
5'-XXXXXXXXXXXXXXXXXXXXXXXXX-3'
3'-YXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M26" or "M26" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M27" or "M27" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M28" or "M28" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29" or "M29" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M30" or "M30" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M31" or "M31" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M32" or "M32" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34" or "M34" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35" or "M35" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37" or "M37" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38" or "M38" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXXDD-3'

3'-YXXXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M40" or "M40" modification pattern.

In additional embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M41" or "M41" modification pattern.

In further embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

5'-XXXXXXXXXXXXXXXXXXXXXXXXXDD-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M36" or "M36" modification pattern.

In additional embodiments, the DsiRNA comprises:

5'-XXXXXXXXXXXXXXXXXXXXXXXXX-3'

3'-YXXXXXXXXXXXXXXXXXXXXXXXXX-5' wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M42" or "M42" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M43" or "M43" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M44" or "M44" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M45" or "M45" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M46" or "M46" modification pattern.

In further embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M47" or "M47" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M48" or "M48" modification pattern.

In further embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M52" or "M52" modification pattern.

In additional embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M7*" or "M7*" modification pattern.

In further embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M6*" or "M6*" modification pattern.

In other embodiments, the DsiRNA comprises:

```
5'-XXXXXXXXXXXXXXXXXXXXXXXXX-3'
3'-XXXXXXXXXXXXXXXXXXXXXXXXX-5'
``` wherein "X"=RNA and "X"=2'-O-methyl RNA. The top strand is the sense strand, and the bottom strand is the antisense strand. In another related embodiment, the DsiRNA comprises:

```
5'-XXXXXXXXXXXXXXXXXXXXXXXDD-3'
3'-XXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M5*" or "M5*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M4*" or "M4*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M8*" or "M8*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M2*" or "M2*" modification pattern.

In other embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M10*" or "M10*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M11*" or "M11*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M13*" or "M13*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M14*" or "M14*" modification pattern.

In additional embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

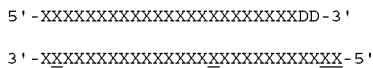

wherein "X"=RNA, "X"=2'-O-methyl RNA, and "D"=DNA. The top strand is the sense strand, and the bottom strand is the antisense strand. This modification pattern is also referred to herein as the "AS-M15*" or "M15*" modification pattern.

In further embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M16*" or "M16*" modification pattern.

In additional embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

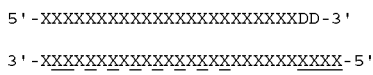

wherein "X"=RNA, "X"=2'-O-methyl RNA, and "D"=DNA. The top strand is the sense strand, and the bottom strand is the antisense strand. This modification pattern is also referred to herein as the "AS-M17*" or "M17*" modification pattern.

In further embodiments, the DsiRNA comprises:

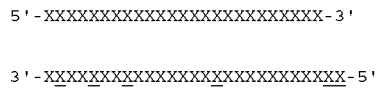

wherein "X"=RNA and "X"=2'-O-methyl RNA. The top strand is the sense strand, and the bottom strand is the antisense strand. In a further related embodiment, the DsiRNA comprises:

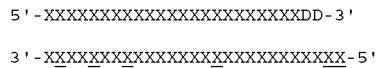

wherein "X"=RNA, "X"=2'-O-methyl RNA, and "D"=DNA. The top strand is the sense strand, and the bottom strand is the antisense strand. This modification pattern is also referred to herein as the "AS-M18*" or "M18*" modification pattern.

In additional embodiments, the DsiRNA comprises:

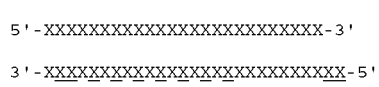

wherein "X"=RNA and "X"=2'-O-methyl RNA. The top strand is the sense strand, and the bottom strand is the antisense strand. In a further related embodiment, the DsiRNA comprises:

wherein "X"=RNA, "X"=2'-O-methyl RNA, and "D"=DNA. The top strand is the sense strand, and the bottom strand is the antisense strand. This modification pattern is also referred to herein as the "AS-M19*" or "M19*" modification pattern.

In further embodiments, the DsiRNA comprises:

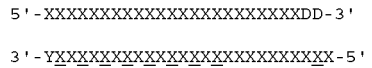

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M20*" or "M20*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M22*" or "M22*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M24*" or "M24*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M25*" or "M25*" modification pattern.

In further embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M26*" or "M26*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M27*" or "M27*" modification pattern.

In additional embodiments, the DsiRNA comprises:

5'-XXXXXXXXXXXXXXXXXXXXXXXXX-3'

3'-XXXXXXXXXXXXXXXXXXXXXXXXXXX-5' wherein "X"=RNA and "X"=2'-O-methyl RNA. The top strand is the sense strand, and the bottom strand is the antisense strand. In a further related embodiment, the DsiRNA comprises:

5'-XXXXXXXXXXXXXXXXXXXXXXXXXDD-3'

3'-XXXXXXXXXXXXXXXXXXXXXXXXXXX-5' wherein "X"=RNA, "X"=2'-O-methyl RNA, and "D"=DNA. The top strand is the sense strand, and the bottom strand is the antisense strand. This modification pattern is also referred to herein as the "AS-M28*" or "M28*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M29*" or "M29*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M34*" or "M34*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M35*" or "M35*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M37*" or "M37*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M38*" or "M38*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M40*" or "M40*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M41*" or "M41*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M36*" or "M36*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M42*" or "M42*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M43*" or "M43*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M44*" or "M44*" modification pattern.

In further embodiments, the DsiRNA comprises:

```
5'-XXXXXXXXXXXXXXXXXXXXXXXXX-3'

3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M46*" or "M46*" modification pattern.

In additional embodiments, the DsiRNA comprises:

```
5'-XXXXXXXXXXXXXXXXXXXXXXXXX-3'

3'-XXXXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXXDD-3'

3'-XXXXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M47*" or "M47*" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M48*" or "M48*" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M52*" or "M52*" modification pattern.

In more embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M54" or "M54" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M54*" or "M54*" modification pattern.

In additional embodiments, the DsiRNA comprises:

```
5'-XXXXXXXXXXXXXXXXXXXXXXXXX-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXDD-3'
3'-YXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X̲"=2'-O-methyl RNA. The top strand is the sense strand, and the bottom strand is the antisense strand. In a further related embodiment, the DsiRNA comprises:

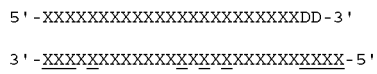

wherein "X"=RNA, "X̲"=2'-O-methyl RNA, and "D"=DNA. The top strand is the sense strand, and the bottom strand is the antisense strand. This modification pattern is also referred to herein as the "AS-M55" or "M55" modification pattern.

In further embodiments, the DsiRNA comprises:

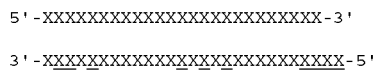

wherein "X"=RNA and "X̲"=2'-O-methyl RNA. The top strand is the sense strand, and the bottom strand is the antisense strand. In a further related embodiment, the DsiRNA comprises:

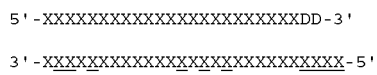

wherein "X"=RNA, "X̲"=2'-O-methyl RNA, and "D"=DNA. The top strand is the sense strand, and the bottom strand is the antisense strand. This modification pattern is also referred to herein as the "AS-M55*" or "M55*" modification pattern.

In more embodiments, the DsiRNA comprises:

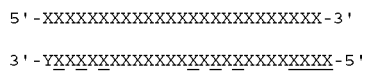

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

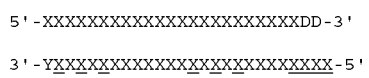

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

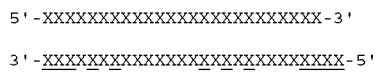

wherein "X"=RNA and "X̲"=2'-O-methyl RNA. The top strand is the sense strand, and the bottom strand is the antisense strand. In a further related embodiment, the DsiRNA comprises:

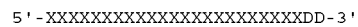
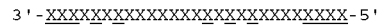

wherein "X"=RNA, "X̲"=2'-O-methyl RNA, and "D"=DNA. The top strand is the sense strand, and the bottom strand is the antisense strand. This modification pattern is also referred to herein as the "AS-M56" or "M56" modification pattern.

In additional embodiments, the DsiRNA comprises:

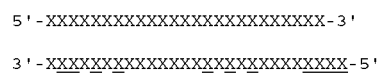

wherein "X"=RNA and "X̲"=2'-O-methyl RNA. The top strand is the sense strand, and the bottom strand is the antisense strand. In a further related embodiment, the DsiRNA comprises:

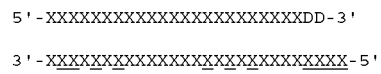

wherein "X"=RNA, "X̲"=2'-O-methyl RNA, and "D"=DNA. The top strand is the sense strand, and the bottom strand is the antisense strand. This modification pattern is also referred to herein as the "AS-M56*" or "M56*" modification pattern.

In further embodiments, the DsiRNA comprises:

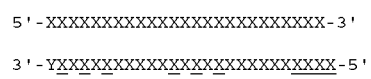

wherein "X"=RNA, "X̲"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

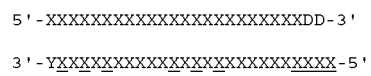

wherein "X"=RNA, "X̲"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

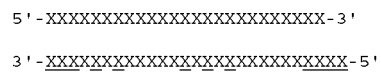

wherein "X"=RNA and "X̲"=2'-O-methyl RNA. The top strand is the sense strand, and the bottom strand is the antisense strand. In a further related embodiment, the DsiRNA comprises:

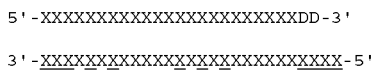

wherein "X"=RNA, "X"=2'-O-methyl RNA, and "D"=DNA. The top strand is the sense strand, and the bottom strand is the antisense strand. This modification pattern is also referred to herein as the "AS-M57" or "M57" modification pattern.

In more embodiments, the DsiRNA comprises:

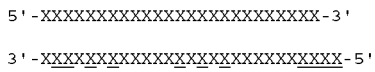

wherein "X"=RNA and "X"=2'-O-methyl RNA. The top strand is the sense strand, and the bottom strand is the antisense strand. In a further related embodiment, the DsiRNA comprises:

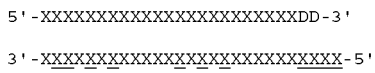

wherein "X"=RNA, "X"=2'-O-methyl RNA, and "D"=DNA. The top strand is the sense strand, and the bottom strand is the antisense strand. This modification pattern is also referred to herein as the "AS-M57*" or "M57*" modification pattern.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

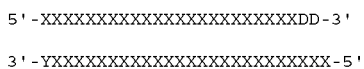

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

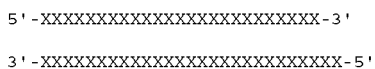

wherein "X"=RNA and "X"=2'-O-methyl RNA. The top strand is the sense strand, and the bottom strand is the antisense strand. In a further related embodiment, the DsiRNA comprises:

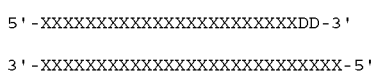

wherein "X"=RNA, "X"=2'-O-methyl RNA, and "D"=DNA. The top strand is the sense strand, and the bottom strand is the antisense strand. This modification pattern is also referred to herein as the "AS-M58" or "M58" modification pattern.

In further embodiments, the DsiRNA comprises:

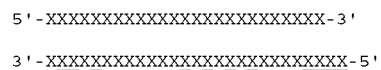

wherein "X"=RNA and "X"=2'-O-methyl RNA. The top strand is the sense strand, and the bottom strand is the antisense strand. In a further related embodiment, the DsiRNA comprises:

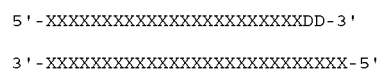

wherein "X"=RNA, "X"=2'-O-methyl RNA, and "D"=DNA. The top strand is the sense strand, and the bottom strand is the antisense strand. This modification pattern is also referred to herein as the "AS-M58*" or "M58*" modification pattern.

In more embodiments, the DsiRNA comprises:

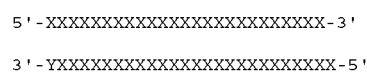

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

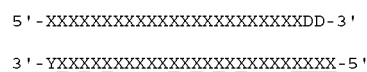

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

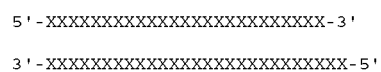

wherein "X"=RNA and "X"=2'-O-methyl RNA. The top strand is the sense strand, and the bottom strand is the antisense strand. In a further related embodiment, the DsiRNA comprises:

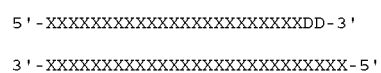

wherein "X"=RNA, "X"=2'-O-methyl RNA, and "D"=DNA. The top strand is the sense strand, and the bottom strand is the antisense strand. This modification pattern is also referred to herein as the "AS-M59" or "M59" modification pattern.

In further embodiments, the DsiRNA comprises:

wherein "X"=RNA and "X"=2'-O-methyl RNA. The top strand is the sense strand, and the bottom strand is the antisense strand. In a further related embodiment, the DsiRNA comprises:

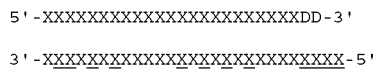

wherein "X"=RNA, "X"=2'-O-methyl RNA, and "D"=DNA. The top strand is the sense strand, and the bottom strand is the antisense strand. This modification pattern is also referred to herein as the "AS-M59*" or "M59*" modification pattern.

In additional embodiments, the DsiRNA comprises:

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

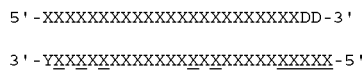

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

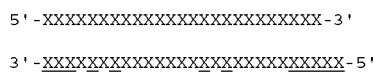

wherein "X"=RNA and "X"=2'-O-methyl RNA. The top strand is the sense strand, and the bottom strand is the antisense strand. In a further related embodiment, the DsiRNA comprises:

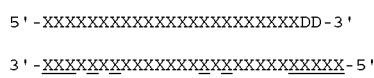

wherein "X"=RNA, "X"=2'-O-methyl RNA, and "D"=DNA. The top strand is the sense strand, and the bottom strand is the antisense strand. This modification pattern is also referred to herein as the "AS-M60" or "M60" modification pattern.

In more embodiments, the DsiRNA comprises:

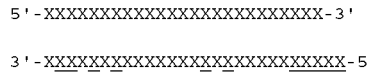

wherein "X"=RNA and "X"=2'-O-methyl RNA. The top strand is the sense strand, and the bottom strand is the antisense strand. In a further related embodiment, the DsiRNA comprises:

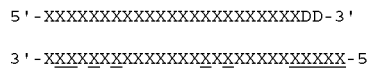

wherein "X"=RNA, "X"=2'-O-methyl RNA, and "D"=DNA. The top strand is the sense strand, and the bottom strand is the antisense strand. This modification pattern is also referred to herein as the "AS-M60*" or "M60*" modification pattern.

In further embodiments, the DsiRNA comprises:

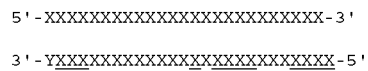

wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

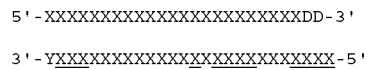

wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

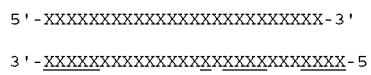

wherein "X"=RNA and "X"=2'-O-methyl RNA. The top strand is the sense strand, and the bottom strand is the antisense strand. In a further related embodiment, the DsiRNA comprises:

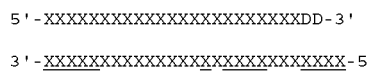

wherein "X"=RNA, "X"=2'-O-methyl RNA, and "D"=DNA. The top strand is the sense strand, and the bottom strand is the antisense strand. This modification pattern is also referred to herein as the "AS-M61" or "M61" modification pattern.

In additional embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M61*" or "M61*" modification pattern.

In more embodiments, the DsiRNA comprises:

```
5'-XXXXXXXXXXXXXXXXXXXXXXXXX-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers and underlined residues are 2'-O-methyl RNA monomers. The top strand is the sense strand, and the bottom strand is the antisense strand. In one related embodiment, the DsiRNA comprises:

```
5'-XXXXXXXXXXXXXXXXXXXXXXXXDD-3'
3'-YXXXXXXXXXXXXXXXXXXXXXXXXXX-5'
``` wherein "X"=RNA, "X"=2'-O-methyl RNA, "Y" is an overhang domain comprised of 1-4 RNA monomers that are optionally 2'-O-methyl RNA monomers, underlined residues are 2'-O-methyl RNA monomers, and "D"=DNA. The top strand is the sense strand, and the bottom strand is the antisense strand. In another related embodiment, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M62" or "M62" modification pattern.

In further embodiments, the DsiRNA comprises:

```
5'-XXXXXXXXXXXXXXXXXXXXXXXXX-3'
3'-XXXXXXXXXXXXXXXXXXXXXXXXXXX-5'
``` wherein "X"=RNA and "X"=2'-O-methyl RNA. The top strand is the sense strand, and the bottom strand is the antisense strand. In a further related embodiment, the DsiRNA comprises:

```
5'-XXXXXXXXXXXXXXXXXXXXXXXXDD-3'
3'-XXXXXXXXXXXXXXXXXXXXXXXXXXX-5'
``` wherein "X"=RNA, "X"=2'-O-methyl RNA, and "D"=DNA. The top strand is the sense strand, and the bottom strand is the antisense strand. This modification pattern is also referred to herein as the "AS-M62*" or "M62*" modification pattern.

In certain embodiments, the sense strand of a DsiRNA of the invention is modified—specific exemplary forms of sense strand modifications are shown below, and it is contemplated that such modified sense strands can be substituted for the sense strand of any of the DsiRNAs shown above to generate a DsiRNA comprising a below-depicted sense strand that anneals with an above-depicted antisense strand. Exemplary sense strand modification patterns include:

```
5'-XXXXXXXXXXXXXXXXXXXXXXXXDD-3'     "SM1"
5'-XXXXXXXXXXXXXXXXXXXXXXXXDD-3'     "SM2"
5'-XXXXXXXXXXXXXXXXXXXXXXXXDD-3'     "SM3"
5'-XXXXXXXXXXXXXXXXXXXXXXXXDD-3'     "SM4"
5'-XXXXXXXXXXXXXXXXXXXXXXXXDD-3'     "SM5"
5'-XXXXXXXXXXXXXXXXXXXXXXXXDD-3'     "SM6"
5'-XXXXXXXXXXXXXXXXXXXXXXXXDD-3'     "SM7"
5'-XXXXXXXXXXXXXXXXXXXXXXXXDD-3'     "SM8"
5'-XXXXXXXXXXXXXXXXXXXXXXXXDD-3'     "SM9"
5'-XXXXXXXXXXXXXXXXXXXXXXXXDD-3'     "SM10"
5'-XXXXXXXXXXXXXXXXXXXXXXXXDD-3'     "SM11"
5'-XXXXXXXXXXXXXXXXXXXXXXXXDD-3'     "SM12"
5'-XXXXXXXXXXXXXXXXXXXXXXXXDD-3'     "SM13"
5'-XXXXXXXXXXXXXXXXXXXXXXXXDD-3'     "SM14"
5'-XXXXXXXXXXXXXXXXXXXXXXXXDD-3'     "SM15"
5'-XXXXXXXXXXXXXXXXXXXXXXXXDD-3'     "SM16"
5'-XXXXXXXXXXXXXXXXXXXXXXXXDD-3'     "SM17"
5'-XXXXXXXXXXXXXXXXXXXXXXXXDD-3'     "SM18"
5'-XXXXXXXXXXXXXXXXXXXXXXXXDD-3'     "SM19"
5'-XXXXXXXXXXXXXXXXXXXXXXXXDD-3'     "SM20"
5'-XXXXXXXXXXXXXXXXXXXXXXXXDD-3'     "SM21"
5'-XXXXXXXXXXXXXXXXXXXXXXXXDD-3'     "SM23"
```

-continued

5'-XXXXXXXXXXXXXXXXXXXXXXXXXDD-3'    "SM24"
5'-XXXXXXXXXXXXXXXXXXXXXXXXXDD-3'    "SM25"
5'-XXXXXXXXXXXXXXXXXXXXXXXXXDD-3'    "SM30"
5'-XXXXXXXXXXXXXXXXXXXXXXXXXDD-3'    "SM31"
5'-XXXXXXXXXXXXXXXXXXXXXXXXXDD-3'    "SM32"
5'-XXXXXXXXXXXXXXXXXXXXXXXXXDD-3'    "SM33"
5'-XXXXXXXXXXXXXXXXXXXXXXXXXDD-3'    "SM34"
5'-XXXXXXXXXXXXXXXXXXXXXXXXXDD-3'    "SM35"
5'-XXXXXXXXXXXXXXXXXXXXXXXXXDD-3'    "SM36"
5'-XXXXXXXXXXXXXXXXXXXXXXXXXDD-3'    "SM37"
5'-XXXXXXXXXXXXXXXXXXXXXXXXXDD-3'    "SM38"
5'-XXXXXXXXXXXXXXXXXXXXXXXXXDD-3'    "SM39"
5'-XXXXXXXXXXXXXXXXXXXXXXXXXDD-3'    "SM40"
5'-XXXXXXXXXXXXXXXXXXXXXXXXXDD-3'    "SM41"
5'-XXXXXXXXXXXXXXXXXXXXXXXXXDD-3'    "SM42"
5'-XXXXXXXXXXXXXXXXXXXXXXXXXDD-3'    "SM43"
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'

-continued

5'-XXXXXXXXXXXXXXXXXXXXXXXXXXX-3'
5'-XXXXXXXXXXXXXXXXXXXXXXXXXXX-3'
5'-XXXXXXXXXXXXXXXXXXXXXXXXXXX-3'    "SM22"

where "X"=RNA, "$\underline{X}$"=2'-O-methyl RNA, and "D"=DNA.

The above modification patterns can also be incorporated into, e.g., the extended DsiRNA structures and mismatch and/or frayed DsiRNA structures described below.

In another embodiment, the DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary 27mer DsiRNA agent with two terminal mismatched residues is shown:

$$5'\text{-XXXXXXXXXXXXXXXXXXXXXXXXXX}_M M\text{-}3'$$
$$3'\text{-XXXXXXXXXXXXXXXXXXXXXXXXXX}_M M\text{-}5'$$

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand is the sense strand, and the bottom strand is the antisense strand. Alternatively, the bottom strand is the sense strand and the top strand is the antisense strand.

In certain additional embodiments, the present invention provides compositions for RNA interference (RNAi) that possess one or more base paired deoxyribonucleotides within a region of a double stranded ribonucleic acid (dsRNA) that is positioned 3' of a projected sense strand Dicer cleavage site and correspondingly 5' of a projected antisense strand Dicer cleavage site. The compositions of the invention comprise a dsRNA which is a precursor molecule, i.e., the dsRNA of the present invention is processed in vivo to produce an active small interfering nucleic acid (siRNA). The dsRNA is processed by Dicer to an active siRNA which is incorporated into RISC.

In certain embodiments, the DsiRNA agents of the invention can have the following exemplary structures (noting that any of the following exemplary structures can be combined, e.g., with the bottom strand modification patterns of the above-described structures—in one specific example, the bottom strand modification pattern shown in any of the above structures is applied to the 27 most 3' residues of the bottom strand of any of the following structures; in another specific example, the bottom strand modification pattern shown in any of the above structures upon the 23 most 3' residues of the bottom strand is applied to the 23 most 3' residues of the bottom strand of any of the following structures):

In one such embodiment, the DsiRNA comprises the following (an exemplary "right-extended", "DNA extended" DsiRNA):

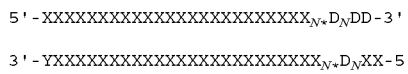

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

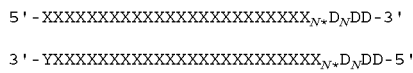

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

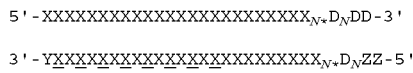

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

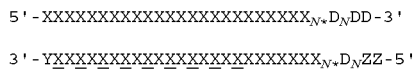

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

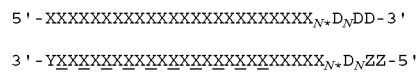

wherein "X"=RNA, "$\underline{X}$"=2'-O-methyl RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

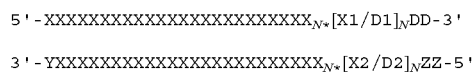

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In the structures depicted herein, the 5' end of either the sense strand or antisense strand can optionally comprise a phosphate group.

In another embodiment, a DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

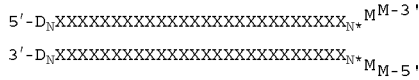

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-15 or, optionally, 1-8. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In one embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. An exemplary structure for such a molecule is shown:

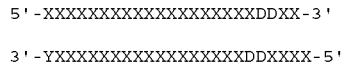

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. In one embodiment, the top strand is the sense strand, and the bottom strand is the antisense strand. Alternatively, the bottom strand is the sense strand and the top strand is the antisense strand. The above structure is modeled to force Dicer to cleave a minimum of a 21mer duplex as its primary post-processing form. In embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In one embodiment, the DsiRNA comprises the following (an exemplary "left-extended", "DNA extended" DsiRNA):

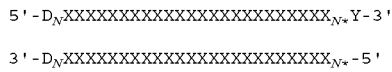

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, "D"=DNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In a related embodiment, the DsiRNA comprises:

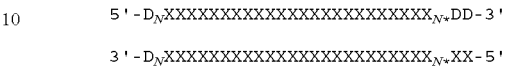

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In an additional embodiment, the DsiRNA comprises:

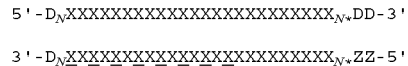

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

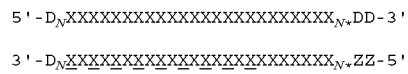

wherein "X"=RNA, optionally a 2'-O-methyl RNA monomers "D"=DNA, "N"=1 to 50 or more, but is optionally 1-8 or 1-10. "N*"=0 to 15 or more, but is optionally 0, 1, 2, 3, 4, 5 or 6. "Z"=DNA or RNA. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

wherein "X"=RNA, "$\underline{X}$"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another such embodiment, the DsiRNA comprises:

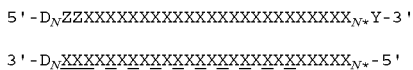

wherein "X"=RNA, "X"=2'-O-methyl RNA, "D"=DNA, "Z"=DNA or RNA, and "N"=1 to 50 or more, but is optionally 1-8 or 1-10. "N*"=0 to 15 or more, but is optionally 0, 1, 2, 3, 4, 5 or 6. "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DsiRNA comprises:

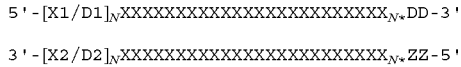

wherein "X"=RNA, "D"=DNA, "Z"=DNA or RNA, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In a related embodiment, the DsiRNA comprises:

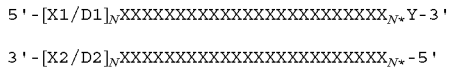

wherein "X"=RNA, "D"=DNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "N"=1 to 50 or more, but is optionally 1-8 or 1-10, where at least one $D1_N$ is present in the top strand and is base paired with a corresponding $D2_N$ in the bottom strand. Optionally, $D1_N$ and $D1_{N+1}$ are base paired with corresponding $D2_N$ and $D2_{N+1}$; $D1_N$, $D1_{N+1}$ and $D1_{N+2}$ are base paired with corresponding $D2_N$, $D1_{N+1}$ and $D1_{N+2}$, etc. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand, with 2'-O-methyl RNA monomers located at alternating residues along the top strand, rather than the bottom strand presently depicted in the above schematic.

In another embodiment, the DNA:DNA-extended DsiRNA comprises strands having equal lengths possessing 1-3 mismatched residues that serve to orient Dicer cleavage (specifically, one or more of positions 1, 2 or 3 on the first strand of the DsiRNA, when numbering from the 3'-terminal residue, are mismatched with corresponding residues of the 5'-terminal region on the second strand when first and second strands are annealed to one another). An exemplary DNA:DNA-extended DsiRNA agent with two terminal mismatched residues is shown:

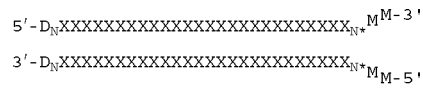

wherein "X"=RNA, "M"=Nucleic acid residues (RNA, DNA or non-natural or modified nucleic acids) that do not base pair (hydrogen bond) with corresponding "M" residues of otherwise complementary strand when strands are annealed, "D"=DNA and "N"=1 to 50 or more, but is optionally 1-8 or 1-10. "N*"=0 to 15 or more, but is optionally 0, 1, 2, 3, 4, 5 or 6. Any of the residues of such agents can optionally be 2'-O-methyl RNA monomers—alternating positioning of 2'-O-methyl RNA monomers that commences from the 3'-terminal residue of the bottom (second) strand, as shown for above asymmetric agents, can also be used in the above "blunt/fray" DsiRNA agent. In one embodiment, the top strand (first strand) is the sense strand, and the bottom strand (second strand) is the antisense strand. Alternatively, the bottom strand is the sense strand and the top strand is the antisense strand. Modification and DNA:DNA extension patterns paralleling those shown above for asymmetric/overhang agents can also be incorporated into such "blunt/frayed" agents.

In another embodiment, a length-extended DsiRNA agent is provided that comprises deoxyribonucleotides positioned at sites modeled to function via specific direction of Dicer cleavage, yet which does not require the presence of a base-paired deoxyribonucleotide in the dsRNA structure. Exemplary structures for such a molecule are shown:

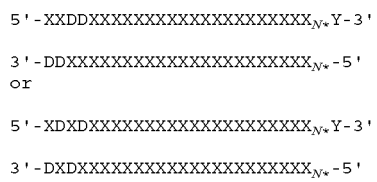

wherein "X"=RNA, "Y" is an optional overhang domain comprised of 0-10 RNA monomers that are optionally 2'-O-methyl RNA monomers—in certain embodiments, "Y" is an overhang domain comprised of 1-4 RNA monomers that are optionally 2'-O-methyl RNA monomers, and "D"=DNA. "N*"=0 to 15 or more, but is optionally 0, 1, 2, 3, 4, 5 or 6. In one embodiment, the top strand is the sense strand, and the bottom strand is the antisense strand. Alternatively, the bottom strand is the sense strand and the top strand is the antisense strand.

In any of the above embodiments where the bottom strand of the above structure is the antisense strand, the positioning of two deoxyribonucleotide residues at the ultimate and penultimate residues of the 5' end of the antisense strand will help reduce off-target effects (as prior studies have shown a 2'-O-methyl modification of at least the penultimate position from the 5' terminus of the antisense strand to reduce off-target effects; see, e.g., US 2007/0223427).

In certain embodiments, the "D" residues of the above structures include at least one PS-DNA or PS-RNA. Optionally, the "D" residues of the above structures include at least one modified nucleotide that inhibits Dicer cleavage.

While the above-described "DNA-extended" DsiRNA agents can be categorized as either "left extended" or "right extended", DsiRNA agents comprising both left- and right-extended DNA-containing sequences within a single agent (e.g., both flanks surrounding a core dsRNA structure are dsDNA extensions) can also be generated and used in similar manner to those described herein for "right-extended" and "left-extended" agents.

In some embodiments, the DsiRNA of the instant invention further comprises a linking moiety or domain that joins the sense and antisense strands of a DNA:DNA-extended DsiRNA agent. Optionally, such a linking moiety domain joins the 3' end of the sense strand and the 5' end of the antisense strand. The linking moiety may be a chemical (non-nucleotide) linker, such as an oligomethylenediol linker, oligoethylene glycol linker, or other art-recognized linker moiety. Alternatively, the linker can be a nucleotide linker, optionally including an extended loop and/or tetral-oop.

In one embodiment, the DsiRNA agent has an asymmetric structure, with the sense strand having a 25-base pair length, and the antisense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxynucleotides at the 3' end of the sense strand.

In another embodiment, the DsiRNA agent has an asymmetric structure, with the antisense strand having a 25-base pair length, and the sense strand having a 27-base pair length with a 1-4 base 3'-overhang (e.g., a one base 3'-overhang, a two base 3'-overhang, a three base 3'-overhang or a four base 3'-overhang). In another embodiment, this DsiRNA agent has an asymmetric structure further containing 2 deoxyribonucleotides at the 3' end of the antisense strand.

Exemplary CKAP5 targeting DsiRNA agents of the invention, and their associated CKAP5 target sequences, include the following, presented in the below series of tables:

Table Number:
(2) Selected Human Anti-CKAP5 DsiRNA Agents (Asymmetrics);
(3) Selected Human Anti-CKAP5 DsiRNAs, Unmodified Duplexes (Asymmetrics);
(4) DsiRNA Target Sequences (21mers) In CKAP5 mRNA;
(5) Selected Human Anti-CKAP5 "Blunt/Fray" DsiRNAs;
(6) Selected Human Anti-CKAP5 "Blunt/Blunt" DsiRNAs; and
(7) DsiRNA Component 19 Nucleotide Target Sequences In CKAP5 mRNA.

TABLE 2

Selected Human Anti-CKAP5 DsiRNA Agents (Asymmetrics)

```
                 5'-GAAGCACAAUGGGAGAUGACAGUga-3'     (SEQ ID NO: 1)
                 3'-ACCUUCGUGUUACCCUCUACUGUCACU-5'   (SEQ ID NO: 577)
CKAP5-143 Target: 5'-TGGAAGCACAATGGGAGATGACAGTGA-3'  (SEQ ID NO: 1153)

5'-AGCACAAUGGGAGAUGACAGUGAgt-3'    (SEQ ID NO: 2)
                 3'-CUUCGUGUUACCCUCUACUGUCACUCA-5'  (SEQ ID NO: 578)
CKAP5-145 Target: 5'-GAAGCACAATGGGAGATGACAGTGAGT-3' (SEQ ID NO: 1154)

5'-CACAAUGGGAGAUGACAGUGAGUgg-3'    (SEQ ID NO: 3)
                 3'-UCGUGUUACCCUCUACUGUCACUCACC-5'  (SEQ ID NO: 579)
CKAP5-147 Target: 5'-AGCACAATGGGAGATGACAGTGAGTGG-3' (SEQ ID NO: 1155)

5'-CAAUGGGAGAUGACAGUGAGUGGtt-3'    (SEQ ID NO: 4)
                 3'-GUGUUACCCUCUACUGUCACUCACCAA-5'  (SEQ ID NO: 580)
CKAP5-149 Target: 5'-CACAATGGGAGATGACAGTGAGTGGTT-3' (SEQ ID NO: 1156)

5'-AUGGGAGAUGACAGUGAGUGGUUga-3'    (SEQ ID NO: 5)
                 3'-GUUACCCUCUACUGUCACUCACCAACU-5'  (SEQ ID NO: 581)
CKAP5-151 Target: 5'-CAATGGGAGATGACAGTGAGTGGTTGA-3' (SEQ ID NO: 1157)

5'-GGGAGAUGACAGUGAGUGGUUGAaa-3'    (SEQ ID NO: 6)
                 3'-UACCCUCUACUGUCACUCACCAACUUU-5'  (SEQ ID NO: 582)
CKAP5-153 Target: 5'-ATGGGAGATGACAGTGAGTGGTTGAAA-3' (SEQ ID NO: 1158)

5'-GAGAUGACAGUGAGUGGUUGAAAct-3'    (SEQ ID NO: 7)
                 3'-CCCUCUACUGUCACUCACCAACUUUGA-5'  (SEQ ID NO: 583)
CKAP5-155 Target: 5'-GGGAGATGACAGTGAGTGGTTGAAACT-3' (SEQ ID NO: 1159)

5'-GAUGACAGUGAGUGGUUGAAACUgc-3'    (SEQ ID NO: 8)
                 3'-CUCUACUGUCACUCACCAACUUUGACG-5'  (SEQ ID NO: 584)
CKAP5-157 Target: 5'-GAGATGACAGTGAGTGGTTGAAACTGC-3' (SEQ ID NO: 1160)

5'-UGACAGUGAGUGGUUGAAACUGCca-3'    (SEQ ID NO: 9)
                 3'-CUACUGUCACUCACCAACUUUGACGGU-5'  (SEQ ID NO: 585)
CKAP5-159 Target: 5'-GATGACAGTGAGTGGTTGAAACTGCCA-3' (SEQ ID NO: 1161)

5'-GAAGAUCUUCCAGAAAAUAAAGGat-3'    (SEQ ID NO: 10)
                 3'-GACUUCUAGAAGGUCUUUUAUUUCCUA-5'  (SEQ ID NO: 586)
CKAP5-246 Target: 5'-CTGAAGATCTTCCAGAAAATAAAGGAT-3' (SEQ ID NO: 1162)

5'-AGAUCUUCCAGAAAAUAAAGGAUga-3'    (SEQ ID NO: 11)
                 3'-CUUCUAGAAGGUCUUUUAUUUCCUACU-5'  (SEQ ID NO: 587)
CKAP5-248 Target: 5'-GAAGATCTTCCAGAAAATAAAGGATGA-3' (SEQ ID NO: 1163)
```

TABLE 2-continued

Selected Human Anti-CKAP5 DsiRNA Agents (Asymmetrics)

|  |  |  |
|---|---|---|
| CKAP5-250 Target: | 5'-AUCUUCCAGAAAAUAAAGGAUGAaa-3'<br>3'-UCUAGAAGGUCUUUUAUUUCCUACUUU-5'<br>5'-AGATCTTCCAGAAAATAAAGGATGAAA-3' | (SEQ ID NO: 12)<br>(SEQ ID NO: 588)<br>(SEQ ID NO: 1164) |
| CKAP5-252 Target: | 5'-CUUCCAGAAAAUAAAGGAUGAAAag-3'<br>3'-UAGAAGGUCUUUUAUUUCCUACUUUUC-5'<br>5'-ATCTTCCAGAAAATAAAGGATGAAAAG-3' | (SEQ ID NO: 13)<br>(SEQ ID NO: 589)<br>(SEQ ID NO: 1165) |
| CKAP5-254 Target: | 5'-UCCAGAAAAUAAAGGAUGAAAAGag-3'<br>3'-GAAGGUCUUUUAUUUCCUACUUUUCUC-5'<br>5'-CTTCCAGAAAATAAAGGATGAAAAGAG-3' | (SEQ ID NO: 14)<br>(SEQ ID NO: 590)<br>(SEQ ID NO: 1166) |
| CKAP5-256 Target: | 5'-CAGAAAAUAAAGGAUGAAAAGAGcc-3'<br>3'-AGGUCUUUUAUUUCCUACUUUUCUCGG-5'<br>5'-TCCAGAAAATAAAGGATGAAAAGAGCC-3' | (SEQ ID NO: 15)<br>(SEQ ID NO: 591)<br>(SEQ ID NO: 1167) |
| CKAP5-258 Target: | 5'-GAAAAUAAAGGAUGAAAAGAGCCca-3'<br>3'-GUCUUUUAUUUCCUACUUUUCUCGGGU-5'<br>5'-CAGAAAATAAAGGATGAAAAGAGCCCA-3' | (SEQ ID NO: 16)<br>(SEQ ID NO: 592)<br>(SEQ ID NO: 1168) |
| CKAP5-260 Target: | 5'-AAAUAAAGGAUGAAAAGAGCCCAga-3'<br>3'-CUUUUAUUUCCUACUUUUCUCGGGUCU-5'<br>5'-GAAAATAAAGGATGAAAAGAGCCCAGA-3' | (SEQ ID NO: 17)<br>(SEQ ID NO: 593)<br>(SEQ ID NO: 1169) |
| CKAP5-308 Target: | 5'-UCAAAAAAUUUGUCACUGAUUCCaa-3'<br>3'-CUAGUUUUUUAAACAGUGACUAAGGUU-5'<br>5'-GATCAAAAAATTTGTCACTGATTCCAA-3' | (SEQ ID NO: 18)<br>(SEQ ID NO: 594)<br>(SEQ ID NO: 1170) |
| CKAP5-310 Target: | 5'-AAAAAAUUUGUCACUGAUUCCAAtg-3'<br>3'-AGUUUUUUAAACAGUGACUAAGGUUAC-5'<br>5'-TCAAAAAATTTGTCACTGATTCCAATG-3' | (SEQ ID NO: 19)<br>(SEQ ID NO: 595)<br>(SEQ ID NO: 1171) |
| CKAP5-312 Target: | 5'-AAAAUUUGUCACUGAUUCCAAUGca-3'<br>3'-UUUUUUAAACAGUGACUAAGGUUACGU-5'<br>5'-AAAAAATTTGTCACTGATTCCAATGCA-3' | (SEQ ID NO: 20)<br>(SEQ ID NO: 596)<br>(SEQ ID NO: 1172) |
| CKAP5-314 Target: | 5'-AAUUUGUCACUGAUUCCAAUGCAgt-3'<br>3'-UUUUAAACAGUGACUAAGGUUACGUCA-5'<br>5'-AAAATTTGTCACTGATTCCAATGCAGT-3' | (SEQ ID NO: 21)<br>(SEQ ID NO: 597)<br>(SEQ ID NO: 1173) |
| CKAP5-316 Target: | 5'-UUUGUCACUGAUUCCAAUGCAGUgg-3'<br>3'-UUAAACAGUGACUAAGGUUACGUCACC-5'<br>5'-AATTTGTCACTGATTCCAATGCAGTGG-3' | (SEQ ID NO: 22)<br>(SEQ ID NO: 598)<br>(SEQ ID NO: 1174) |
| CKAP5-318 Target: | 5'-UGUCACUGAUUCCAAUGCAGUGGtt-3'<br>3'-AAACAGUGACUAAGGUUACGUCACCAA-5'<br>5'-TTTGTCACTGATTCCAATGCAGTGGTT-3' | (SEQ ID NO: 23)<br>(SEQ ID NO: 599)<br>(SEQ ID NO: 1175) |
| CKAP5-320 Target: | 5'-UCACUGAUUCCAAUGCAGUGGUUca-3'<br>3'-ACAGUGACUAAGGUUACGUCACCAAGU-5'<br>5'-TGTCACTGATTCCAATGCAGTGGTTCA-3' | (SEQ ID NO: 24)<br>(SEQ ID NO: 600)<br>(SEQ ID NO: 1176) |
| CKAP5-322 Target: | 5'-ACUGAUUCCAAUGCAGUGGUUCAat-3'<br>3'-AGUGACUAAGGUUACGUCACCAAGUUA-5'<br>5'-TCACTGATTCCAATGCAGTGGTTCAAT-3' | (SEQ ID NO: 25)<br>(SEQ ID NO: 601)<br>(SEQ ID NO: 1177) |
| CKAP5-324 Target: | 5'-UGAUUCCAAUGCAGUGGUUCAAUtg-3'<br>3'-UGACUAAGGUUACGUCACCAAGUUAAC-5'<br>5'-ACTGATTCCAATGCAGTGGTTCAATTG-3' | (SEQ ID NO: 26)<br>(SEQ ID NO: 602)<br>(SEQ ID NO: 1178) |
| CKAP5-326 Target: | 5'-AUUCCAAUGCAGUGGUUCAAUUGaa-3'<br>3'-ACUAAGGUUACGUCACCAAGUUAACUU-5'<br>5'-TGATTCCAATGCAGTGGTTCAATTGAA-3' | (SEQ ID NO: 27)<br>(SEQ ID NO: 603)<br>(SEQ ID NO: 1179) |
| CKAP5-328 Target: | 5'-UCCAAUGCAGUGGUUCAAUUGAAag-3'<br>3'-UAAGGUUACGUCACCAAGUUAACUUUC-5'<br>5'-ATTCCAATGCAGTGGTTCAATTGAAAG-3' | (SEQ ID NO: 28)<br>(SEQ ID NO: 604)<br>(SEQ ID NO: 1180) |
| CKAP5-330 Target: | 5'-CAAUGCAGUGGUUCAAUUGAAAGga-3'<br>3'-AGGUUACGUCACCAAGUUAACUUUCCU-5'<br>5'-TCCAATGCAGTGGTTCAATTGAAAGGA-3' | (SEQ ID NO: 29)<br>(SEQ ID NO: 605)<br>(SEQ ID NO: 1181) |
| CKAP5-332 Target: | 5'-AUGCAGUGGUUCAAUUGAAAGGAtt-3'<br>3'-GUUACGUCACCAAGUUAACUUUCCUAA-5'<br>5'-CAATGCAGTGGTTCAATTGAAAGGATT-3' | (SEQ ID NO: 30)<br>(SEQ ID NO: 606)<br>(SEQ ID NO: 1182) |

TABLE 2-continued

Selected Human Anti-CKAP5 DsiRNA Agents (Asymmetrics)

|  |  |  |
|---|---|---|
| CKAP5-334 Target: | 5'-GCAGUGGUUCAAUUGAAAGGAUUag-3'<br>3'-UACGUCACCAAGUUAACUUUCCUAAUC-5'<br>5'-ATGCAGTGGTTCAATTGAAAGGATTAG-3' | (SEQ ID NO: 31)<br>(SEQ ID NO: 607)<br>(SEQ ID NO: 1183) |
| CKAP5-336 Target: | 5'-AGUGGUUCAAUUGAAAGGAUUAGaa-3'<br>3'-CGUCACCAAGUUAACUUUCCUAAUCUU-5'<br>5'-GCAGTGGTTCAATTGAAAGGATTAGAA-3' | (SEQ ID NO: 32)<br>(SEQ ID NO: 608)<br>(SEQ ID NO: 1184) |
| CKAP5-565 Target: | 5'-AAGAUCAUAGUGGCCUGUAUAGAga-3'<br>3'-GGUUCUAGUAUCACCGGACAUAUCUCU-5'<br>5'-CCAAGATCATAGTGGCCTGTATAGAGA-3' | (SEQ ID NO: 33)<br>(SEQ ID NO: 609)<br>(SEQ ID NO: 1185) |
| CKAP5-567 Target: | 5'-GAUCAUAGUGGCCUGUAUAGAGAca-3'<br>3'-UUCUAGUAUCACCGGACAUAUCUCUGU-5'<br>5'-AAGATCATAGTGGCCTGTATAGAGACA-3' | (SEQ ID NO: 34)<br>(SEQ ID NO: 610)<br>(SEQ ID NO: 1186) |
| CKAP5-569 Target: | 5'-UCAUAGUGGCCUGUAUAGAGACAct-3'<br>3'-CUAGUAUCACCGGACAUAUCUCUGUGA-5'<br>5'-GATCATAGTGGCCTGTATAGAGACACT-3' | (SEQ ID NO: 35)<br>(SEQ ID NO: 611)<br>(SEQ ID NO: 1187) |
| CKAP5-590 Target: | 5'-CACUGAGGAAAGCCUUAAGUGAAtt-3'<br>3'-CUGUGACUCCUUUCGGAAUUCACUUAA-5'<br>5'-GACACTGAGGAAAGCCTTAAGTGAATT-3' | (SEQ ID NO: 36)<br>(SEQ ID NO: 612)<br>(SEQ ID NO: 1188) |
| CKAP5-592 Target: | 5'-CUGAGGAAAGCCUUAAGUGAAUUtg-3'<br>3'-GUGACUCCUUUCGGAAUUCACUUAAAC-5'<br>5'-CACTGAGGAAAGCCTTAAGTGAATTTG-3' | (SEQ ID NO: 37)<br>(SEQ ID NO: 613)<br>(SEQ ID NO: 1189) |
| CKAP5-594 Target: | 5'-GAGGAAAGCCUUAAGUGAAUUUGgt-3'<br>3'-GACUCCUUUCGGAAUUCACUUAAACCA-5'<br>5'-CTGAGGAAAGCCTTAAGTGAATTTGGT-3' | (SEQ ID NO: 38)<br>(SEQ ID NO: 614)<br>(SEQ ID NO: 1190) |
| CKAP5-596 Target: | 5'-GGAAAGCCUUAAGUGAAUUUGGUtc-3'<br>3'-CUCCUUUCGGAAUUCACUUAAACCAAG-5'<br>5'-GAGGAAAGCCTTAAGTGAATTTGGTTC-3' | (SEQ ID NO: 39)<br>(SEQ ID NO: 615)<br>(SEQ ID NO: 1191) |
| CKAP5-598 Target: | 5'-AAAGCCUUAAGUGAAUUUGGUUCca-3'<br>3'-CCUUUCGGAAUUCACUUAAACCAAGGU-5'<br>5'-GGAAAGCCTTAAGTGAATTTGGTTCCA-3' | (SEQ ID NO: 40)<br>(SEQ ID NO: 616)<br>(SEQ ID NO: 1192) |
| CKAP5-600 Target: | 5'-AGCCUUAAGUGAAUUUGGUUCCAaa-3'<br>3'-UUUCGGAAUUCACUUAAACCAAGGUUU-5'<br>5'-AAAGCCTTAAGTGAATTTGGTTCCAAA-3' | (SEQ ID NO: 41)<br>(SEQ ID NO: 617)<br>(SEQ ID NO: 1193) |
| CKAP5-602 Target: | 5'-CCUUAAGUGAAUUUGGUUCCAAAat-3'<br>3'-UCGGAAUUCACUUAAACCAAGGUUUUA-5'<br>5'-AGCCTTAAGTGAATTTGGTTCCAAAAT-3' | (SEQ ID NO: 42)<br>(SEQ ID NO: 618)<br>(SEQ ID NO: 1194) |
| CKAP5-604 Target: | 5'-UUAAGUGAAUUUGGUUCCAAAAUca-3'<br>3'-GGAAUUCACUUAAACCAAGGUUUUAGU-5'<br>5'-CCTTAAGTGAATTTGGTTCCAAAATCA-3' | (SEQ ID NO: 43)<br>(SEQ ID NO: 619)<br>(SEQ ID NO: 1195) |
| CKAP5-606 Target: | 5'-AAGUGAAUUUGGUUCCAAAAUCAtc-3'<br>3'-AAUUCACUUAAACCAAGGUUUUAGUAG-5'<br>5'-TTAAGTGAATTTGGTTCCAAAATCATC-3' | (SEQ ID NO: 44)<br>(SEQ ID NO: 620)<br>(SEQ ID NO: 1196) |
| CKAP5-608 Target: | 5'-GUGAAUUUGGUUCCAAAAUCAUCtt-3'<br>3'-UUCACUUAAACCAAGGUUUUAGUAGAA-5'<br>5'-AAGTGAATTTGGTTCCAAAATCATCTT-3' | (SEQ ID NO: 45)<br>(SEQ ID NO: 621)<br>(SEQ ID NO: 1197) |
| CKAP5-610 Target: | 5'-GAAUUUGGUUCCAAAAUCAUCUUgc-3'<br>3'-CACUUAAACCAAGGUUUUAGUAGAACG-5'<br>5'-GTGAATTTGGTTCCAAAATCATCTTGC-3' | (SEQ ID NO: 46)<br>(SEQ ID NO: 622)<br>(SEQ ID NO: 1198) |
| CKAP5-612 Target: | 5'-AUUUGGUUCCAAAAUCAUCUUGCtt-3'<br>3'-CUUAAACCAAGGUUUUAGUAGAACGAA-5'<br>5'-GAATTTGGTTCCAAAATCATCTTGCTT-3' | (SEQ ID NO: 47)<br>(SEQ ID NO: 623)<br>(SEQ ID NO: 1199) |
| CKAP5-847 Target: | 5'-CGUUCCCAACAAGAACUAGAAGCta-3'<br>3'-AAGCAAGGGUUGUUCUUGAUCUUCGAU-5'<br>5'-TTCGTTCCCAACAAGAACTAGAAGCTA-3' | (SEQ ID NO: 48)<br>(SEQ ID NO: 624)<br>(SEQ ID NO: 1200) |
| CKAP5-849 Target: | 5'-UUCCCAACAAGAACUAGAAGCUAaa-3'<br>3'-GCAAGGGUUGUUCUUGAUCUUCGAUUU-5'<br>5'-CGTTCCCAACAAGAACTAGAAGCTAAA-3' | (SEQ ID NO: 49)<br>(SEQ ID NO: 625)<br>(SEQ ID NO: 1201) |

TABLE 2-continued

Selected Human Anti-CKAP5 DsiRNA Agents (Asymmetrics)

```
                   5'-CCCAACAAGAACUAGAAGCUAAAtt-3'      (SEQ ID NO: 50)
                   3'-AAGGGUUGUUCUUGAUCUUCGAUUUAA-5'    (SEQ ID NO: 626)
CKAP5-851 Target:  5'-TTCCCAACAAGAACTAGAAGCTAAATT-3'    (SEQ ID NO: 1202)

5'-CAACAAGAACUAGAAGCUAAAUUgg-3'      (SEQ ID NO: 51)
                   3'-GGGUUGUUCUUGAUCUUCGAUUUAACC-5'    (SEQ ID NO: 627)
CKAP5-853 Target:  5'-CCCAACAAGAACTAGAAGCTAAATTGG-3'    (SEQ ID NO: 1203)

5'-ACAAGAACUAGAAGCUAAAUUGGaa-3'      (SEQ ID NO: 52)
                   3'-GUUGUUCUUGAUCUUCGAUUUAACCUU-5'    (SEQ ID NO: 628)
CKAP5-855 Target:  5'-CAACAAGAACTAGAAGCTAAATTGGAA-3'    (SEQ ID NO: 1204)

5'-AACAGUCUGCUGGUGGAGAUGCUga-3'      (SEQ ID NO: 53)
                   3'-UGUUGUCAGACGACCACCUCUACGACU-5'    (SEQ ID NO: 629)
CKAP5-884 Target:  5'-ACAACAGTCTGCTGGTGGAGATGCTGA-3'    (SEQ ID NO: 1205)

5'-CAGUCUGCUGGUGGAGAUGCUGAag-3'      (SEQ ID NO: 54)
                   3'-UUGUCAGACGACCACCUCUACGACUUC-5'    (SEQ ID NO: 630)
CKAP5-886 Target:  5'-AACAGTCTGCTGGTGGAGATGCTGAAG-3'    (SEQ ID NO: 1206)

5'-GUGGUGAUGAUGGUGAUGAGGUGcc-3'      (SEQ ID NO: 55)
                   3'-UCCACCACUACUACCACUACUCCACGG-5'    (SEQ ID NO: 631)
CKAP5-914 Target:  5'-AGGTGGTGATGATGGTGATGAGGTGCC-3'    (SEQ ID NO: 1207)

5'-GGUGAUGAUGGUGAUGAGGUGCCac-3'      (SEQ ID NO: 56)
                   3'-CACCACUACUACCACUACUCCACGGUG-5'    (SEQ ID NO: 632)
CKAP5-916 Target:  5'-GTGGTGATGATGGTGATGAGGTGCCAC-3'    (SEQ ID NO: 1208)

5'-AUCCUUUCCAAACUUCCCAAAGAct-3'      (SEQ ID NO: 57)
                   3'-UUUAGGAAAGGUUUGAAGGGUUUCUGA-5'    (SEQ ID NO: 633)
CKAP5-976 Target:  5'-AAATCCTTTCCAAACTTCCCAAAGACT-3'    (SEQ ID NO: 1209)

5'-CCUUUCCAAACUUCCCAAAGACUtt-3'      (SEQ ID NO: 58)
                   3'-UAGGAAAGGUUUGAAGGGUUUCUGAAA-5'    (SEQ ID NO: 634)
CKAP5-978 Target:  5'-ATCCTTTCCAAACTTCCCAAAGACTTT-3'    (SEQ ID NO: 1210)

5'-UUUCCAAACUUCCCAAAGACUUUta-3'      (SEQ ID NO: 59)
                   3'-GGAAAGGUUUGAAGGGUUUCUGAAAAU-5'    (SEQ ID NO: 635)
CKAP5-980 Target:  5'-CCTTTCCAAACTTCCCAAAGACTTTTA-3'    (SEQ ID NO: 1211)

5'-UCCAAACUUCCCAAAGACUUUUAtg-3'      (SEQ ID NO: 60)
                   3'-AAAGGUUUGAAGGGUUUCUGAAAAUAC-5'    (SEQ ID NO: 636)
CKAP5-982 Target:  5'-TTTCCAAACTTCCCAAAGACTTTTATG-3'    (SEQ ID NO: 1212)

5'-CAAACUUCCCAAAGACUUUUAUGac-3'      (SEQ ID NO: 61)
                   3'-AGGUUUGAAGGGUUUCUGAAAAUACUG-5'    (SEQ ID NO: 637)
CKAP5-984 Target:  5'-TCCAAACTTCCCAAAGACTTTTATGAC-3'    (SEQ ID NO: 1213)

5'-AACUUCCCAAAGACUUUUAUGACaa-3'      (SEQ ID NO: 62)
                   3'-GUUUGAAGGGUUUCUGAAAAUACUGUU-5'    (SEQ ID NO: 638)
CKAP5-986 Target:  5'-CAAACTTCCCAAAGACTTTTATGACAA-3'    (SEQ ID NO: 1214)

5'-CUUCCCAAAGACUUUUAUGACAAaa-3'      (SEQ ID NO: 63)
                   3'-UUGAAGGGUUUCUGAAAAUACUGUUUU-5'    (SEQ ID NO: 639)
CKAP5-988 Target:  5'-AACTTCCCAAAGACTTTTATGACAAAA-3'    (SEQ ID NO: 1215)

5'-UCCCAAAGACUUUUAUGACAAAAtt-3'      (SEQ ID NO: 64)
                   3'-GAAGGGUUUCUGAAAAUACUGUUUUAA-5'    (SEQ ID NO: 640)
CKAP5-990 Target:  5'-CTTCCCAAAGACTTTTATGACAAAATT-3'    (SEQ ID NO: 1216)

5'-CCAAAGACUUUUAUGACAAAAUUga-3'      (SEQ ID NO: 65)
                   3'-AGGGUUUCUGAAAAUACUGUUUUAACU-5'    (SEQ ID NO: 641)
CKAP5-992 Target:  5'-TCCCAAAGACTTTTATGACAAAATTGA-3'    (SEQ ID NO: 1217)

5'-AAAGACUUUUAUGACAAAAUUGAgg-3'      (SEQ ID NO: 66)
                   3'-GGUUUCUGAAAAUACUGUUUUAACUCC-5'    (SEQ ID NO: 642)
CKAP5-994 Target:  5'-CCAAAGACTTTTATGACAAAATTGAGG-3'    (SEQ ID NO: 1218)

5'-AGACUUUUAUGACAAAAUUGAGGca-3'      (SEQ ID NO: 67)
                   3'-UUUCUGAAAAUACUGUUUUAACUCCGU-5'    (SEQ ID NO: 643)
CKAP5-996 Target:  5'-AAAGACTTTTATGACAAAATTGAGGCA-3'    (SEQ ID NO: 1219)

5'-ACUUUUAUGACAAAAUUGAGGCAaa-3'      (SEQ ID NO: 68)
                   3'-UCUGAAAAUACUGUUUUAACUCCGUUU-5'    (SEQ ID NO: 644)
CKAP5-998 Target:  5'-AGACTTTTATGACAAAATTGAGGCAAA-3'    (SEQ ID NO: 1220)
```

TABLE 2-continued

Selected Human Anti-CKAP5 DsiRNA Agents (Asymmetrics)

```
                   5'-UUUUAUGACAAAAUUGAGGCAAAaa-3'       (SEQ ID NO: 69)
                   3'-UGAAAAUACUGUUUUAACUCCGUUUUU-5'     (SEQ ID NO: 645)
CKAP5-1000 Target: 5'-ACTTTTATGACAAAATTGAGGCAAAAA-3'     (SEQ ID NO: 1221)

5'-UUAUGACAAAAUUGAGGCAAAAAaa-3'      (SEQ ID NO: 70)
                   3'-AAAAUACUGUUUUAACUCCGUUUUUUU-5'    (SEQ ID NO: 646)
CKAP5-1002 Target: 5'-TTTTATGACAAAATTGAGGCAAAAAAA-3'    (SEQ ID NO: 1222)

5'-AUGACAAAAUUGAGGCAAAAAAAtg-3'      (SEQ ID NO: 71)
                   3'-AAUACUGUUUUAACUCCGUUUUUUUAC-5'    (SEQ ID NO: 647)
CKAP5-1004 Target: 5'-TTATGACAAAATTGAGGCAAAAAAATG-3'    (SEQ ID NO: 1223)

5'-AAUGGCAAGAGAGAAAAGAGGCCct-3'      (SEQ ID NO: 72)
                   3'-UUUUACCGUUCUCUCUUUUCUCCGGGA-5'    (SEQ ID NO: 648)
CKAP5-1025 Target: 5'-AAAATGGCAAGAGAGAAAAGAGGCCCT-3'    (SEQ ID NO: 1224)

5'-AGGUUGUUGGAAAGGACACCAAUgt-3'      (SEQ ID NO: 73)
                   3'-CUUCCAACAACCUUUCCUGUGGUUACA-5'    (SEQ ID NO: 649)
CKAP5-1127 Target: 5'-GAAGGTTGTTGGAAAGGACACCAATGT-3'    (SEQ ID NO: 1225)

5'-GUUGUUGGAAAGGACACCAAUGUca-3'      (SEQ ID NO: 74)
                   3'-UCCAACAACCUUUCCUGUGGUUACAGU-5'    (SEQ ID NO: 650)
CKAP5-1129 Target: 5'-AGGTTGTTGGAAAGGACACCAATGTCA-3'    (SEQ ID NO: 1226)

5'-UGUUGGAAAGGACACCAAUGUCAtg-3'      (SEQ ID NO: 75)
                   3'-CAACAACCUUUCCUGUGGUUACAGUAC-5'    (SEQ ID NO: 651)
CKAP5-1131 Target: 5'-GTTGTTGGAAAGGACACCAATGTCATG-3'    (SEQ ID NO: 1227)

5'-UUGGAAAGGACACCAAUGUCAUGtt-3'      (SEQ ID NO: 76)
                   3'-ACAACCUUUCCUGUGGUUACAGUACAA-5'    (SEQ ID NO: 652)
CKAP5-1133 Target: 5'-TGTTGGAAAGGACACCAATGTCATGTT-3'    (SEQ ID NO: 1228)

5'-GGAAAGGACACCAAUGUCAUGUUgg-3'      (SEQ ID NO: 77)
                   3'-AACCUUUCCUGUGGUUACAGUACAACC-5'    (SEQ ID NO: 653)
CKAP5-1135 Target: 5'-TTGGAAAGGACACCAATGTCATGTTGG-3'    (SEQ ID NO: 1229)

5'-AAAGGACACCAAUGUCAUGUUGGtg-3'      (SEQ ID NO: 78)
                   3'-CCUUUCCUGUGGUUACAGUACAACCAC-5'    (SEQ ID NO: 654)
CKAP5-1137 Target: 5'-GGAAAGGACACCAATGTCATGTTGGTG-3'    (SEQ ID NO: 1230)

5'-AGGACACCAAUGUCAUGUUGGUGgc-3'      (SEQ ID NO: 79)
                   3'-UUUCCUGUGGUUACAGUACAACCACCG-5'    (SEQ ID NO: 655)
CKAP5-1139 Target: 5'-AAAGGACACCAATGTCATGTTGGTGGC-3'    (SEQ ID NO: 1231)

5'-GACACCAAUGUCAUGUUGGUGGCtt-3'      (SEQ ID NO: 80)
                   3'-UCCUGUGGUUACAGUACAACCACCGAA-5'    (SEQ ID NO: 656)
CKAP5-1141 Target: 5'-AGGACACCAATGTCATGTTGGTGGCTT-3'    (SEQ ID NO: 1232)

5'-GCUUUGGCAGCAAAAUGUCUUACtg-3'      (SEQ ID NO: 81)
                   3'-ACCGAAACCGUCGUUUUACAGAAUGAC-5'    (SEQ ID NO: 657)
CKAP5-1162 Target: 5'-TGGCTTTGGCAGCAAAATGTCTTACTG-3'    (SEQ ID NO: 1233)

5'-UUUGGCAGCAAAAUGUCUUACUGgc-3'      (SEQ ID NO: 82)
                   3'-CGAAACCGUCGUUUUACAGAAUGACCG-5'    (SEQ ID NO: 658)
CKAP5-1164 Target: 5'-GCTTTGGCAGCAAAATGTCTTACTGGC-3'    (SEQ ID NO: 1234)

5'-UGGCAGCAAAAUGUCUUACUGGCct-3'      (SEQ ID NO: 83)
                   3'-AAACCGUCGUUUUACAGAAUGACCGGA-5'    (SEQ ID NO: 659)
CKAP5-1166 Target: 5'-TTTGGCAGCAAAATGTCTTACTGGCCT-3'    (SEQ ID NO: 1235)

5'-GCAGCAAAAUGUCUUACUGGCCUgg-3'      (SEQ ID NO: 84)
                   3'-ACCGUCGUUUUACAGAAUGACCGGACC-5'    (SEQ ID NO: 660)
CKAP5-1168 Target: 5'-TGGCAGCAAAATGTCTTACTGGCCTGG-3'    (SEQ ID NO: 1236)

5'-AGCAAAAUGUCUUACUGGCCUGGct-3'      (SEQ ID NO: 85)
                   3'-CGUCGUUUUACAGAAUGACCGGACCGA-5'    (SEQ ID NO: 661)
CKAP5-1170 Target: 5'-GCAGCAAAATGTCTTACTGGCCTGGCT-3'    (SEQ ID NO: 1237)

5'-AGAAAUUUGGACAAUAUGCAGGAca-3'      (SEQ ID NO: 86)
                   3'-CUUCUUUAAACCUGUUAUACGUCCUGU-5'    (SEQ ID NO: 662)
CKAP5-1208 Target: 5'-GAAGAAATTTGGACAATATGCAGGACA-3'    (SEQ ID NO: 1238)

5'-AAAUUUGGACAAUAUGCAGGACAtg-3'      (SEQ ID NO: 87)
                   3'-UCUUUAAACCUGUUAUACGUCCUGUAC-5'    (SEQ ID NO: 663)
CKAP5-1210 Target: 5'-AGAAATTTGGACAATATGCAGGACATG-3'    (SEQ ID NO: 1239)
```

TABLE 2-continued

Selected Human Anti-CKAP5 DsiRNA Agents (Asymmetrics)

```
                 5'-AUUUGGACAAUAUGCAGGACAUGUtt-3'      (SEQ ID NO: 88)
                 3'-UUUAAACCUGUUAUACGUCCUGUACAA-5'     (SEQ ID NO: 664)
CKAP5-1212 Target:5'-AAATTTGGACAATATGCAGGACATGTT-3'    (SEQ ID NO: 1240)

5'-UUGGACAAUAUGCAGGACAUGUUgt-3'       (SEQ ID NO: 89)
                 3'-UAAACCUGUUAUACGUCCUGUACAACA-5'     (SEQ ID NO: 665)
CKAP5-1214 Target:5'-ATTTGGACAATATGCAGGACATGTTGT-3'    (SEQ ID NO: 1241)

5'-GGACAAUAUGCAGGACAUGUUGUgc-3'       (SEQ ID NO: 90)
                 3'-AACCUGUUAUACGUCCUGUACAACACG-5'     (SEQ ID NO: 666)
CKAP5-1216 Target:5'-TTGGACAATATGCAGGACATGTTGTGC-3'    (SEQ ID NO: 1242)

5'-ACAAUAUGCAGGACAUGUUGUGCca-3'       (SEQ ID NO: 91)
                 3'-CCUGUUAUACGUCCUGUACAACACGGU-5'     (SEQ ID NO: 667)
CKAP5-1218 Target:5'-GGACAATATGCAGGACATGTTGTGCCA-3'    (SEQ ID NO: 1243)

5'-AAUAUGCAGGACAUGUUGUGCCAac-3'       (SEQ ID NO: 92)
                 3'-UGUUAUACGUCCUGUACAACACGGUUG-5'     (SEQ ID NO: 668)
CKAP5-1220 Target:5'-ACAATATGCAGGACATGTTGTGCCAAC-3'    (SEQ ID NO: 1244)

5'-UAUGCAGGACAUGUUGUGCCAACca-3'       (SEQ ID NO: 93)
                 3'-UUAUACGUCCUGUACAACACGGUUGGU-5'     (SEQ ID NO: 669)
CKAP5-1222 Target:5'-AATATGCAGGACATGTTGTGCCAACCA-3'    (SEQ ID NO: 1245)

5'-UGCAGGACAUGUUGUGCCAACCAtc-3'       (SEQ ID NO: 94)
                 3'-AUACGUCCUGUACAACACGGUUGGUAG-5'     (SEQ ID NO: 670)
CKAP5-1224 Target:5'-TATGCAGGACATGTTGTGCCAACCATC-3'    (SEQ ID NO: 1246)

5'-CAGGACAUGUUGUGCCAACCAUCtt-3'       (SEQ ID NO: 95)
                 3'-ACGUCCUGUACAACACGGUUGGUAGAA-5'     (SEQ ID NO: 671)
CKAP5-1226 Target:5'-TGCAGGACATGTTGTGCCAACCATCTT-3'    (SEQ ID NO: 1247)

5'-CUCAAGUGGUACAAGCCCUGCAGga-3'       (SEQ ID NO: 96)
                 3'-UGGAGUUCACCAUGUUCGGGACGUCCU-5'     (SEQ ID NO: 672)
CKAP5-1274 Target:5'-ACCTCAAGTGGTACAAGCCCTGCAGGA-3'    (SEQ ID NO: 1248)

5'-CAAGUGGUACAAGCCCUGCAGGAgg-3'       (SEQ ID NO: 97)
                 3'-GAGUUCACCAUGUUCGGGACGUCCUCC-5'     (SEQ ID NO: 673)
CKAP5-1276 Target:5'-CTCAAGTGGTACAAGCCCTGCAGGAGG-3'    (SEQ ID NO: 1249)

5'-AGUGGUACAAGCCCUGCAGGAGGca-3'       (SEQ ID NO: 98)
                 3'-GUUCACCAUGUUCGGGACGUCCUCCGU-5'     (SEQ ID NO: 674)
CKAP5-1278 Target:5'-CAAGTGGTACAAGCCCTGCAGGAGGCA-3'    (SEQ ID NO: 1250)

5'-UGGUACAAGCCCUGCAGGAGGCAat-3'       (SEQ ID NO: 99)
                 3'-UCACCAUGUUCGGGACGUCCUCCGUUA-5'     (SEQ ID NO: 675)
CKAP5-1280 Target:5'-AGTGGTACAAGCCCTGCAGGAGGCAAT-3'    (SEQ ID NO: 1251)

5'-GUACAAGCCCUGCAGGAGGCAAUtg-3'       (SEQ ID NO: 100)
                 3'-ACCAUGUUCGGGACGUCCUCCGUUAAC-5'     (SEQ ID NO: 676)
CKAP5-1282 Target:5'-TGGTACAAGCCCTGCAGGAGGCAATTG-3'    (SEQ ID NO: 1252)

5'-ACAAGCCCUGCAGGAGGCAAUUGat-3'       (SEQ ID NO: 101)
                 3'-CAUGUUCGGGACGUCCUCCGUUAACUA-5'     (SEQ ID NO: 677)
CKAP5-1284 Target:5'-GTACAAGCCCTGCAGGAGGCAATTGAT-3'    (SEQ ID NO: 1253)

5'-AAGCCCUGCAGGAGGCAAUUGAUgc-3'       (SEQ ID NO: 102)
                 3'-UGUUCGGGACGUCCUCCGUUAACUACG-5'     (SEQ ID NO: 678)
CKAP5-1286 Target:5'-ACAAGCCCTGCAGGAGGCAATTGATGC-3'    (SEQ ID NO: 1254)

5'-GCCCUGCAGGAGGCAAUUGAUGCaa-3'       (SEQ ID NO: 103)
                 3'-UUCGGGACGUCCUCCGUUAACUACGUU-5'     (SEQ ID NO: 679)
CKAP5-1288 Target:5'-AAGCCCTGCAGGAGGCAATTGATGCAA-3'    (SEQ ID NO: 1255)

5'-CCUGCAGGAGGCAAUUGAUGCAAtc-3'       (SEQ ID NO: 104)
                 3'-CGGGACGUCCUCCGUUAACUACGUUAG-5'     (SEQ ID NO: 680)
CKAP5-1290 Target:5'-GCCCTGCAGGAGGCAATTGATGCAATC-3'    (SEQ ID NO: 1256)

5'-UGCAGGAGGCAAUUGAUGCAAUCtt-3'       (SEQ ID NO: 105)
                 3'-GGACGUCCUCCGUUAACUACGUUAGAA-5'     (SEQ ID NO: 681)
CKAP5-1292 Target:5'-CCTGCAGGAGGCAATTGATGCAATCTT-3'    (SEQ ID NO: 1257)

5'-CAGGAGGCAAUUGAUGCAAUCUUcc-3'       (SEQ ID NO: 106)
                 3'-ACGUCCUCCGUUAACUACGUUAGAAGG-5'     (SEQ ID NO: 682)
CKAP5-1294 Target:5'-TGCAGGAGGCAATTGATGCAATCTTCC-3'    (SEQ ID NO: 1258)
```

TABLE 2-continued

Selected Human Anti-CKAP5 DsiRNA Agents (Asymmetrics)

```
                5'-GGAGGCAAUUGAUGCAAUCUUCCtt-3'       (SEQ ID NO: 107)
                3'-GUCCUCCGUUAACUACGUUAGAAGGAA-5'     (SEQ ID NO: 683)
CKAP5-1296 Target:5'-CAGGAGGCAATTGATGCAATCTTCCTT-3'   (SEQ ID NO: 1259)

5'-AGGCAAUUGAUGCAAUCUUCCUUac-3'       (SEQ ID NO: 108)
                3'-CCUCCGUUAACUACGUUAGAAGGAAUG-5'     (SEQ ID NO: 684)
CKAP5-1298 Target:5'-GGAGGCAATTGATGCAATCTTCCTTAC-3'   (SEQ ID NO: 1260)

5'-GCAAUUGAUGCAAUCUUCCUUACta-3'       (SEQ ID NO: 109)
                3'-UCCGUUAACUACGUUAGAAGGAAUGAU-5'     (SEQ ID NO: 685)
CKAP5-1300 Target:5'-AGGCAATTGATGCAATCTTCCTTACTA-3'   (SEQ ID NO: 1261)

5'-ACUACCACACUACAGAACAUCAGtg-3'       (SEQ ID NO: 110)
                3'-AAUGAUGGUGUGAUGUCUUGUAGUCAC-5'     (SEQ ID NO: 686)
CKAP5-1321 Target:5'-TTACTACCACACTACAGAACATCAGTG-3'   (SEQ ID NO: 1262)

5'-UACCACACUACAGAACAUCAGUGag-3'       (SEQ ID NO: 111)
                3'-UGAUGGUGUGAUGUCUUGUAGUCACUC-5'     (SEQ ID NO: 687)
CKAP5-1323 Target:5'-ACTACCACACTACAGAACATCAGTGAG-3'   (SEQ ID NO: 1263)

5'-CCACACUACAGAACAUCAGUGAGga-3'       (SEQ ID NO: 112)
                3'-AUGGUGUGAUGUCUUGUAGUCACUCCU-5'     (SEQ ID NO: 688)
CKAP5-1325 Target:5'-TACCACACTACAGAACATCAGTGAGGA-3'   (SEQ ID NO: 1264)

5'-ACACUACAGAACAUCAGUGAGGAtg-3'       (SEQ ID NO: 113)
                3'-GGUGUGAUGUCUUGUAGUCACUCCUAC-5'    (SEQ ID NO: 689)
CKAP5-1327 Target:5'-CCACACTACAGAACATCAGTGAGGATG-3'   (SEQ ID NO: 1265)

5'-ACUACAGAACAUCAGUGAGGAUGtt-3'       (SEQ ID NO: 114)
                3'-UGUGAUGUCUUGUAGUCACUCCUACAA-5'     (SEQ ID NO: 690)
CKAP5-1329 Target:5'-ACACTACAGAACATCAGTGAGGATGTT-3'   (SEQ ID NO: 1266)

5'-UACAGAACAUCAGUGAGGAUGUUtt-3'       (SEQ ID NO: 115)
                3'-UGAUGUCUUGUAGUCACUCCUACAAAA-5'     (SEQ ID NO: 691)
CKAP5-1331 Target:5'-ACTACAGAACATCAGTGAGGATGTTTT-3'   (SEQ ID NO: 1267)

5'-CAGAACAUCAGUGAGGAUGUUUUag-3'       (SEQ ID NO: 116)
                3'-AUGUCUUGUAGUCACUCCUACAAAAUC-5'     (SEQ ID NO: 692)
CKAP5-1333 Target:5'-TACAGAACATCAGTGAGGATGTTTTAG-3'   (SEQ ID NO: 1268)

5'-UUAGCAGUAAUGGAUAAUAAAAAtc-3'       (SEQ ID NO: 117)
                3'-AAAAUCGUCAUUACCUAUUAUUUUUAG-5'     (SEQ ID NO: 693)
CKAP5-1354 Target:5'-TTTTAGCAGTAATGGATAATAAAAATC-3'   (SEQ ID NO: 1269)

5'-AGCAGUAAUGGAUAAUAAAAAUCca-3'       (SEQ ID NO: 118)
                3'-AAUCGUCAUUACCUAUUAUUUUUAGGU-5'     (SEQ ID NO: 694)
CKAP5-1356 Target:5'-TTAGCAGTAATGGATAATAAAAATCCA-3'   (SEQ ID NO: 1270)

5'-CAGUAAUGGAUAAUAAAAAUCCAac-3'       (SEQ ID NO: 119)
                3'-UCGUCAUUACCUAUUAUUUUUAGGUUG-5'     (SEQ ID NO: 695)
CKAP5-1358 Target:5'-AGCAGTAATGGATAATAAAAATCCAAC-3'   (SEQ ID NO: 1271)

5'-GUAAUGGAUAAUAAAAAUCCAACca-3'       (SEQ ID NO: 120)
                3'-GUCAUUACCUAUUAUUUUUAGGUUGGU-5'     (SEQ ID NO: 696)
CKAP5-1360 Target:5'-CAGTAATGGATAATAAAAATCCAACCA-3'   (SEQ ID NO: 1272)

5'-ACCAUCAAGCAGCAGACAUCUCUtt-3'       (SEQ ID NO: 121)
                3'-GUUGGUAGUUCGUCGUCUGUAGAGAAA-5'     (SEQ ID NO: 697)
CKAP5-1381 Target:5'-CAACCATCAAGCAGCAGACATCTCTTT-3'   (SEQ ID NO: 1273)

5'-CUACUUAAGCACAUCAAUGAUUCtg-3'       (SEQ ID NO: 122)
                3'-GUGAUGAAUUCGUGUAGUUACUAAGAC-5'     (SEQ ID NO: 698)
CKAP5-1480 Target:5'-CACTACTTAAGCACATCAATGATTCTG-3'   (SEQ ID NO: 1274)

5'-ACUUAAGCACAUCAAUGAUUCUGct-3'       (SEQ ID NO: 123)
                3'-GAUGAAUUCGUGUAGUUACUAAGACGA-5'     (SEQ ID NO: 699)
CKAP5-1482 Target:5'-CTACTTAAGCACATCAATGATTCTGCT-3'   (SEQ ID NO: 1275)

5'-UUAAGCACAUCAAUGAUUCUGCUcc-3'       (SEQ ID NO: 124)
                3'-UGAAUUCGUGUAGUUACUAAGACGAGG-5'     (SEQ ID NO: 700)
CKAP5-1484 Target:5'-ACTTAAGCACATCAATGATTCTGCTCC-3'   (SEQ ID NO: 1276)

5'-AAGCACAUCAAUGAUUCUGCUCCtg-3'       (SEQ ID NO: 125)
                3'-AAUUCGUGUAGUUACUAAGACGAGGAC-5'     (SEQ ID NO: 701)
CKAP5-1486 Target:5'-TTAAGCACATCAATGATTCTGCTCCTG-3'   (SEQ ID NO: 1277)
```

TABLE 2-continued

Selected Human Anti-CKAP5 DsiRNA Agents (Asymmetrics)

```
                     5'-GCACAUCAAUGAUUCUGCUCCUGaa-3'      (SEQ ID NO: 126)
                     3'-UUCGUGUAGUUACUAAGACGAGGACUU-5'    (SEQ ID NO: 702)
CKAP5-1488 Target: 5'-AAGCACATCAATGATTCTGCTCCTGAA-3'      (SEQ ID NO: 1278)

5'-ACAUCAAUGAUUCUGCUCCUGAAgt-3'      (SEQ ID NO: 127)
                     3'-CGUGUAGUUACUAAGACGAGGACUUCA-5'    (SEQ ID NO: 703)
CKAP5-1490 Target: 5'-GCACATCAATGATTCTGCTCCTGAAGT-3'      (SEQ ID NO: 1279)

5'-AUCAAUGAUUCUGCUCCUGAAGUca-3'      (SEQ ID NO: 128)
                     3'-UGUAGUUACUAAGACGAGGACUUCAGU-5'    (SEQ ID NO: 704)
CKAP5-1492 Target: 5'-ACATCAATGATTCTGCTCCTGAAGTCA-3'      (SEQ ID NO: 1280)

5'-CAAUGAUUCUGCUCCUGAAGUCAga-3'      (SEQ ID NO: 129)
                     3'-UAGUUACUAAGACGAGGACUUCAGUCU-5'    (SEQ ID NO: 705)
CKAP5-1494 Target: 5'-ATCAATGATTCTGCTCCTGAAGTCAGA-3'      (SEQ ID NO: 1281)

5'-AUGAUUCUGCUCCUGAAGUCAGAga-3'      (SEQ ID NO: 130)
                     3'-GUUACUAAGACGAGGACUUCAGUCUCU-5'    (SEQ ID NO: 706)
CKAP5-1496 Target: 5'-CAATGATTCTGCTCCTGAAGTCAGAGA-3'      (SEQ ID NO: 1282)

5'-GAUUCUGCUCCUGAAGUCAGAGAtg-3'      (SEQ ID NO: 131)
                     3'-UACUAAGACGAGGACUUCAGUCUCUAC-5'    (SEQ ID NO: 707)
CKAP5-1498 Target: 5'-ATGATTCTGCTCCTGAAGTCAGAGATG-3'      (SEQ ID NO: 1283)

5'-UUCUGCUCCUGAAGUCAGAGAUGcc-3'      (SEQ ID NO: 132)
                     3'-CUAAGACGAGGACUUCAGUCUCUACGG-5'    (SEQ ID NO: 708)
CKAP5-1500 Target: 5'-GATTCTGCTCCTGAAGTCAGAGATGCC-3'      (SEQ ID NO: 1284)

5'-CUGCUCCUGAAGUCAGAGAUGCCgc-3'      (SEQ ID NO: 133)
                     3'-AAGACGAGGACUUCAGUCUCUACGGCG-5'    (SEQ ID NO: 709)
CKAP5-1502 Target: 5'-TTCTGCTCCTGAAGTCAGAGATGCCGC-3'      (SEQ ID NO: 1285)

5'-GCUCCUGAAGUCAGAGAUGCCGCat-3'      (SEQ ID NO: 134)
                     3'-GACGAGGACUUCAGUCUCUACGGCGUA-5'    (SEQ ID NO: 710)
CKAP5-1504 Target: 5'-CTGCTCCTGAAGTCAGAGATGCCGCAT-3'      (SEQ ID NO: 1286)

5'-GAUCAAAGAAUGUUCAGAAAAGGta-3'      (SEQ ID NO: 135)
                     3'-UUCUAGUUUCUUACAAGUCUUUUCCAU-5'    (SEQ ID NO: 711)
CKAP5-1617 Target: 5'-AAGATCAAAGAATGTTCAGAAAAGGTA-3'      (SEQ ID NO: 1287)

5'-UCAAAGAAUGUUCAGAAAAGGUAga-3'      (SEQ ID NO: 136)
                     3'-CUAGUUUCUUACAAGUCUUUUCCAUCU-5'    (SEQ ID NO: 712)
CKAP5-1619 Target: 5'-GATCAAAGAATGTTCAGAAAAGGTAGA-3'      (SEQ ID NO: 1288)

5'-AACCUGGAUGGAAAGAAACUAAUtt-3'      (SEQ ID NO: 137)
                     3'-CUUUGGACCUACCUUUCUUUGAUUAAA-5'    (SEQ ID NO: 713)
CKAP5-2090 Target: 5'-GAAACCTGGATGGAAAGAAACTAATTT-3'      (SEQ ID NO: 1289)

5'-CCUGGAUGGAAAGAAACUAAUUUtc-3'      (SEQ ID NO: 138)
                     3'-UUGGACCUACCUUUCUUUGAUUAAAAG-5'    (SEQ ID NO: 714)
CKAP5-2092 Target: 5'-AACCTGGATGGAAAGAAACTAATTTTC-3'      (SEQ ID NO: 1290)

5'-UGGAUGGAAAGAAACUAAUUUUCag-3'      (SEQ ID NO: 139)
                     3'-GGACCUACCUUUCUUUGAUUAAAAGUC-5'    (SEQ ID NO: 715)
CKAP5-2094 Target: 5'-CCTGGATGGAAAGAAACTAATTTTCAG-3'      (SEQ ID NO: 1291)

5'-GAUGGAAAGAAACUAAUUUUCAGgt-3'      (SEQ ID NO: 140)
                     3'-ACCUACCUUUCUUUGAUUAAAAGUCCA-5'    (SEQ ID NO: 716)
CKAP5-2096 Target: 5'-TGGATGGAAAGAAACTAATTTTCAGGT-3'      (SEQ ID NO: 1292)

5'-UGGAAAGAAACUAAUUUUCAGGUga-3'      (SEQ ID NO: 141)
                     3'-CUACCUUUCUUUGAUUAAAAGUCCACU-5'    (SEQ ID NO: 717)
CKAP5-2098 Target: 5'-GATGGAAAGAAACTAATTTTCAGGTGA-3'      (SEQ ID NO: 1293)

5'-GAAAGAAACUAAUUUUCAGGUGAtg-3'      (SEQ ID NO: 142)
                     3'-ACCUUUCUUUGAUUAAAAGUCCACUAC-5'    (SEQ ID NO: 718)
CKAP5-2100 Target: 5'-TGGAAAGAAACTAATTTTCAGGTGATG-3'      (SEQ ID NO: 1294)

5'-AAGAAACUAAUUUUCAGGUGAUGca-3'      (SEQ ID NO: 143)
                     3'-CUUUCUUUGAUUAAAAGUCCACUACGU-5'    (SEQ ID NO: 719)
CKAP5-2102 Target: 5'-GAAAGAAACTAATTTTCAGGTGATGCA-3'      (SEQ ID NO: 1295)

5'-GAAACUAAUUUUCAGGUGAUGCAaa-3'      (SEQ ID NO: 144)
                     3'-UUCUUUGAUUAAAAGUCCACUACGUUU-5'    (SEQ ID NO: 720)
CKAP5-2104 Target: 5'-AAGAAACTAATTTTCAGGTGATGCAAA-3'      (SEQ ID NO: 1296)
```

TABLE 2-continued

Selected Human Anti-CKAP5 DsiRNA Agents (Asymmetrics)

```
                  5'-AACUAAUUUUCAGGUGAUGCAAAtg-3'      (SEQ ID NO: 145)
                  3'-CUUUGAUUAAAAGUCCACUACGUUUAC-5'    (SEQ ID NO: 721)
CKAP5-2106 Target:5'-GAAACTAATTTTCAGGTGATGCAAATG-3'    (SEQ ID NO: 1297)

5'-CUAAUUUUCAGGUGAUGCAAAUGaa-3'      (SEQ ID NO: 146)
                  3'-UUGAUUAAAAGUCCACUACGUUUACUU-5'    (SEQ ID NO: 722)
CKAP5-2108 Target:5'-AACTAATTTTCAGGTGATGCAAATGAA-3'    (SEQ ID NO: 1298)

5'-UUGCUUUGAUUGCCCAGAAGGGAaa-3'      (SEQ ID NO: 147)
                  3'-UCAACGAAACUAACGGGUCUUCCCUUU-5'    (SEQ ID NO: 723)
CKAP5-2144 Target:5'-AGTTGCTTTGATTGCCCAGAAGGGAAA-3'    (SEQ ID NO: 1299)

5'-GCUUUGAUUGCCCAGAAGGGAAAtt-3'      (SEQ ID NO: 148)
                  3'-AACGAAACUAACGGGUCUUCCCUUUAA-5'    (SEQ ID NO: 724)
CKAP5-2146 Target:5'-TTGCTTTGATTGCCCAGAAGGGAAATT-3'    (SEQ ID NO: 1300)

5'-UUUGAUUGCCCAGAAGGGAAAUUtt-3'      (SEQ ID NO: 149)
                  3'-CGAAACUAACGGGUCUUCCCUUUAAAA-5'    (SEQ ID NO: 725)
CKAP5-2148 Target:5'-GCTTTGATTGCCCAGAAGGGAAATTTT-3'    (SEQ ID NO: 1301)

5'-UGAUUGCCCAGAAGGGAAAUUUUtc-3'      (SEQ ID NO: 150)
                  3'-AAACUAACGGGUCUUCCCUUUAAAAAG-5'    (SEQ ID NO: 726)
CKAP5-2150 Target:5'-TTTGATTGCCCAGAAGGGAAATTTTTC-3'    (SEQ ID NO: 1302)

5'-AUUGCCCAGAAGGGAAAUUUUUCca-3'      (SEQ ID NO: 151)
                  3'-ACUAACGGGUCUUCCCUUUAAAAAGGU-5'    (SEQ ID NO: 727)
CKAP5-2152 Target:5'-TGATTGCCCAGAAGGGAAATTTTTCCA-3'    (SEQ ID NO: 1303)

5'-UGCCCAGAAGGGAAAUUUUUCCAaa-3'      (SEQ ID NO: 152)
                  3'-UAACGGGUCUUCCCUUUAAAAAGGUUU-5'    (SEQ ID NO: 728)
CKAP5-2154 Target:5'-ATTGCCCAGAAGGGAAATTTTTCCAAA-3'    (SEQ ID NO: 1304)

5'-CCCAGAAGGGAAAUUUUUCCAAAac-3'      (SEQ ID NO: 153)
                  3'-ACGGGUCUUCCCUUUAAAAAGGUUUUG-5'    (SEQ ID NO: 729)
CKAP5-2156 Target:5'-TGCCCAGAAGGGAAATTTTTCCAAAAC-3'    (SEQ ID NO: 1305)

5'-GACAAGAUUGGAGAUGUGAAAUGtg-3'      (SEQ ID NO: 154)
                  3'-ACCUGUUCUAACCUCUACACUUUACAC-5'    (SEQ ID NO: 730)
CKAP5-2212 Target:5'-TGGACAAGATTGGAGATGTGAAATGTG-3'    (SEQ ID NO: 1306)

5'-CAAGAUUGGAGAUGUGAAAUGUGgg-3'      (SEQ ID NO: 155)
                  3'-CUGUUCUAACCUCUACACUUUACACCC-5'    (SEQ ID NO: 731)
CKAP5-2214 Target:5'-GACAAGATTGGAGATGTGAAATGTGGG-3'    (SEQ ID NO: 1307)

5'-AGAUUGGAGAUGUGAAAUGUGGGaa-3'      (SEQ ID NO: 156)
                  3'-GUUCUAACCUCUACACUUUACACCCUU-5'    (SEQ ID NO: 732)
CKAP5-2216 Target:5'-CAAGATTGGAGATGTGAAATGTGGGAA-3'    (SEQ ID NO: 1308)

5'-AUUGGAGAUGUGAAAUGUGGGAAca-3'      (SEQ ID NO: 157)
                  3'-UCUAACCUCUACACUUUACACCCUUGU-5'    (SEQ ID NO: 733)
CKAP5-2218 Target:5'-AGATTGGAGATGTGAAATGTGGGAACA-3'    (SEQ ID NO: 1309)

5'-UGGAGAUGUGAAAUGUGGGAACAat-3'      (SEQ ID NO: 158)
                  3'-UAACCUCUACACUUUACACCCUUGUUA-5'    (SEQ ID NO: 734)
CKAP5-2220 Target:5'-ATTGGAGATGTGAAATGTGGGAACAAT-3'    (SEQ ID NO: 1310)

5'-GAGAUGUGAAAUGUGGGAACAAUgc-3'      (SEQ ID NO: 159)
                  3'-ACCUCUACACUUUACACCCUUGUUACG-5'    (SEQ ID NO: 735)
CKAP5-2222 Target:5'-TGGAGATGTGAAATGTGGGAACAATGC-3'    (SEQ ID NO: 1311)

5'-GAUGUGAAAUGUGGGAACAAUGCaa-3'      (SEQ ID NO: 160)
                  3'-CUCUACACUUUACACCCUUGUUACGUU-5'    (SEQ ID NO: 736)
CKAP5-2224 Target:5'-GAGATGTGAAATGTGGGAACAATGCAA-3'    (SEQ ID NO: 1312)

5'-UGUGAAAUGUGGGAACAAUGCAAaa-3'      (SEQ ID NO: 161)
                  3'-CUACACUUUACACCCUUGUUACGUUUU-5'    (SEQ ID NO: 737)
CKAP5-2226 Target:5'-GATGTGAAATGTGGGAACAATGCAAAA-3'    (SEQ ID NO: 1313)

5'-UGAAAUGUGGGAACAAUGCAAAAga-3'      (SEQ ID NO: 162)
                  3'-ACACUUUACACCCUUGUUACGUUUUCU-5'    (SEQ ID NO: 738)
CKAP5-2228 Target:5'-TGTGAAATGTGGGAACAATGCAAAAGA-3'    (SEQ ID NO: 1314)

5'-AAAUGUGGGAACAAUGCAAAAGAag-3'      (SEQ ID NO: 163)
                  3'-ACUUUACACCCUUGUUACGUUUUCUUC-5'    (SEQ ID NO: 739)
CKAP5-2230 Target:5'-TGAAATGTGGGAACAATGCAAAAGAAG-3'    (SEQ ID NO: 1315)
```

TABLE 2-continued

Selected Human Anti-CKAP5 DsiRNA Agents (Asymmetrics)

```
                  5'-AUGUGGGAACAAUGCAAAAGAAGct-3'      (SEQ ID NO: 164)
                  3'-UUUACACCCUUGUUACGUUUUCUUCGA-5'    (SEQ ID NO: 740)
CKAP5-2232 Target:5'-AAATGTGGGAACAATGCAAAAGAAGCT-3'    (SEQ ID NO: 1316)

5'-GUGGGAACAAUGCAAAAGAAGCUat-3'      (SEQ ID NO: 165)
                  3'-UACACCCUUGUUACGUUUUCUUCGAUA-5'    (SEQ ID NO: 741)
CKAP5-2234 Target:5'-ATGTGGGAACAATGCAAAAGAAGCTAT-3'    (SEQ ID NO: 1317)

5'-GGGAACAAUGCAAAAGAAGCUAUga-3'      (SEQ ID NO: 166)
                  3'-CACCCUUGUUACGUUUUCUUCGAUACU-5'    (SEQ ID NO: 742)
CKAP5-2236 Target:5'-GTGGGAACAATGCAAAAGAAGCTATGA-3'    (SEQ ID NO: 1318)

5'-GUUGAAUGUCAAAGCUUUCAUUAgc-3'      (SEQ ID NO: 167)
                  3'-CCCAACUUACAGUUUCGAAAGUAAUCG-5'    (SEQ ID NO: 743)
CKAP5-2400 Target:5'-GGGTTGAATGTCAAAGCTTTCATTAGC-3'    (SEQ ID NO: 1319)

5'-UGAAUGUCAAAGCUUUCAUUAGCaa-3'      (SEQ ID NO: 168)
                  3'-CAACUUACAGUUUCGAAAGUAAUCGUU-5'    (SEQ ID NO: 744)
CKAP5-2402 Target:5'-GTTGAATGTCAAAGCTTTCATTAGCAA-3'    (SEQ ID NO: 1320)

5'-AAUGUCAAAGCUUUCAUUAGCAAtg-3'      (SEQ ID NO: 169)
                  3'-ACUUACAGUUUCGAAAGUAAUCGUUAC-5'    (SEQ ID NO: 745)
CKAP5-2404 Target:5'-TGAATGTCAAAGCTTTCATTAGCAATG-3'    (SEQ ID NO: 1321)

5'-UGUCAAAGCUUUCAUUAGCAAUGtg-3'      (SEQ ID NO: 170)
                  3'-UUACAGUUUCGAAAGUAAUCGUUACAC-5'    (SEQ ID NO: 746)
CKAP5-2406 Target:5'-AATGTCAAAGCTTTCATTAGCAATGTG-3'    (SEQ ID NO: 1322)

5'-UCAAAGCUUUCAUUAGCAAUGUGaa-3'      (SEQ ID NO: 171)
                  3'-ACAGUUUCGAAAGUAAUCGUUACACUU-5'    (SEQ ID NO: 747)
CKAP5-2408 Target:5'-TGTCAAAGCTTTCATTAGCAATGTGAA-3'    (SEQ ID NO: 1323)

5'-CCCUGCUUGGCGUGAUGUAUCUGta-3'      (SEQ ID NO: 172)
                  3'-UUGGGACGAACCGCACUACAUAGACAU-5'    (SEQ ID NO: 748)
CKAP5-2480 Target:5'-AACCCTGCTTGGCGTGATGTATCTGTA-3'    (SEQ ID NO: 1324)

5'-CUGCUUGGCGUGAUGUAUCUGUAtg-3'      (SEQ ID NO: 173)
                  3'-GGGACGAACCGCACUACAUAGACAUAC-5'    (SEQ ID NO: 749)
CKAP5-2482 Target:5'-CCCTGCTTGGCGTGATGTATCTGTATG-3'    (SEQ ID NO: 1325)

5'-UCUUUGAGGAUGAGAAGCCUGCCct-3'      (SEQ ID NO: 174)
                  3'-CAAGAAACUCCUACUCUUCGGACGGGA-5'    (SEQ ID NO: 750)
CKAP5-2528 Target:5'-GTTCTTTGAGGATGAGAAGCCTGCCCT-3'    (SEQ ID NO: 1326)

5'-UUUGAGGAUGAGAAGCCUGCCCUcc-3'      (SEQ ID NO: 175)
                  3'-AGAAACUCCUACUCUUCGGACGGGAGG-5'    (SEQ ID NO: 751)
CKAP5-2530 Target:5'-TCTTTGAGGATGAGAAGCCTGCCCTCC-3'    (SEQ ID NO: 1327)

5'-UGAGGAUGAGAAGCCUGCCCUCCta-3'      (SEQ ID NO: 176)
                  3'-AAACUCCUACUCUUCGGACGGGAGGAU-5'    (SEQ ID NO: 752)
CKAP5-2532 Target:5'-TTTGAGGATGAGAAGCCTGCCCTCCTA-3'    (SEQ ID NO: 1328)

5'-AGGAUGAGAAGCCUGCCCUCCUAtc-3'      (SEQ ID NO: 177)
                  3'-ACUCCUACUCUUCGGACGGGAGGAUAG-5'    (SEQ ID NO: 753)
CKAP5-2534 Target:5'-TGAGGATGAGAAGCCTGCCCTCCTATC-3'    (SEQ ID NO: 1329)

5'-GAUGAGAAGCCUGCCCUCCUAUCcc-3'      (SEQ ID NO: 178)
                  3'-UCCUACUCUUCGGACGGGAGGAUAGGG-5'    (SEQ ID NO: 754)
CKAP5-2536 Target:5'-AGGATGAGAAGCCTGCCCTCCTATCCC-3'    (SEQ ID NO: 1330)

5'-UGAGAAGCCUGCCCUCCUAUCCCag-3'      (SEQ ID NO: 179)
                  3'-CUACUCUUCGGACGGGAGGAUAGGGUC-5'    (SEQ ID NO: 755)
CKAP5-2538 Target:5'-GATGAGAAGCCTGCCCTCCTATCCCAG-3'    (SEQ ID NO: 1331)

5'-AGAAGCCUGCCCUCCUAUCCCAGat-3'      (SEQ ID NO: 180)
                  3'-ACUCUUCGGACGGGAGGAUAGGGUCUA-5'    (SEQ ID NO: 756)
CKAP5-2540 Target:5'-TGAGAAGCCTGCCCTCCTATCCCAGAT-3'    (SEQ ID NO: 1332)

5'-AAGCCUGCCCUCCUAUCCCAGAUag-3'      (SEQ ID NO: 181)
                  3'-UCUUCGGACGGGAGGAUAGGGUCUAUC-5'    (SEQ ID NO: 757)
CKAP5-2542 Target:5'-AGAAGCCTGCCCTCCTATCCCAGATAG-3'    (SEQ ID NO: 1333)

5'-GCCUGCCCUCCUAUCCCAGAUAGat-3'      (SEQ ID NO: 182)
                  3'-UUCGGACGGGAGGAUAGGGUCUAUCUA-5'    (SEQ ID NO: 758)
CKAP5-2544 Target:5'-AAGCCTGCCCTCCTATCCCAGATAGAT-3'    (SEQ ID NO: 1334)
```

TABLE 2-continued

Selected Human Anti-CKAP5 DsiRNA Agents (Asymmetrics)

```
                 5'-CUGCCCUCCUAUCCCAGAUAGAUgc-3'      (SEQ ID NO: 183)
                 3'-CGGACGGGAGGAUAGGGUCUAUCUACG-5'    (SEQ ID NO: 759)
CKAP5-2546 Target:5'-GCCTGCCCTCCTATCCCAGATAGATGC-3'   (SEQ ID NO: 1335)

5'-GCCCUCCUAUCCCAGAUAGAUGCag-3'      (SEQ ID NO: 184)
                 3'-GACGGGAGGAUAGGGUCUAUCUACGUC-5'    (SEQ ID NO: 760)
CKAP5-2548 Target:5'-CTGCCCTCCTATCCCAGATAGATGCAG-3'   (SEQ ID NO: 1336)

5'-CCUCCUAUCCCAGAUAGAUGCAGaa-3'      (SEQ ID NO: 185)
                 3'-CGGGAGGAUAGGGUCUAUCUACGUCUU-5'    (SEQ ID NO: 761)
CKAP5-2550 Target:5'-GCCCTCCTATCCCAGATAGATGCAGAA-3'   (SEQ ID NO: 1337)

5'-UCCUAUCCCAGAUAGAUGCAGAAtt-3'      (SEQ ID NO: 186)
                 3'-GGAGGAUAGGGUCUAUCUACGUCUUAA-5'    (SEQ ID NO: 762)
CKAP5-2552 Target:5'-CCTCCTATCCCAGATAGATGCAGAATT-3'   (SEQ ID NO: 1338)

5'-CUAUCCCAGAUAGAUGCAGAAUUtg-3'      (SEQ ID NO: 187)
                 3'-AGGAUAGGGUCUAUCUACGUCUUAAAC-5'    (SEQ ID NO: 763)
CKAP5-2554 Target:5'-TCCTATCCCAGATAGATGCAGAATTTG-3'   (SEQ ID NO: 1339)

5'-AUCCCAGAUAGAUGCAGAAUUUGag-3'      (SEQ ID NO: 188)
                 3'-GAUAGGGUCUAUCUACGUCUUAAACUC-5'    (SEQ ID NO: 764)
CKAP5-2556 Target:5'-CTATCCCAGATAGATGCAGAATTTGAG-3'   (SEQ ID NO: 1340)

5'-CCCAGAUAGAUGCAGAAUUUGAGaa-3'      (SEQ ID NO: 189)
                 3'-UAGGGUCUAUCUACGUCUUAAACUCUU-5'    (SEQ ID NO: 765)
CKAP5-2558 Target:5'-ATCCCAGATAGATGCAGAATTTGAGAA-3'   (SEQ ID NO: 1341)

5'-AAGAUGCAGGGACAAAGUCCACCtg-3'      (SEQ ID NO: 190)
                 3'-UCUUCUACGUCCCUGUUUCAGGUGGAC-5'    (SEQ ID NO: 766)
CKAP5-2581 Target:5'-AGAAGATGCAGGGACAAAGTCCACCTG-3'   (SEQ ID NO: 1342)

5'-UACAGAUGAAGGAGAAGAUGGAGat-3'      (SEQ ID NO: 191)
                 3'-CCAUGUCUACUUCCUCUUCUACCUCUA-5'    (SEQ ID NO: 767)
CKAP5-2643 Target:5'-GGTACAGATGAAGGAGAAGATGGAGAT-3'   (SEQ ID NO: 1343)

5'-CAGAUGAAGGAGAAGAUGGAGAUga-3'      (SEQ ID NO: 192)
                 3'-AUGUCUACUUCCUCUUCUACCUCUACU-5'    (SEQ ID NO: 768)
CKAP5-2645 Target:5'-TACAGATGAAGGAGAAGATGGAGATGA-3'   (SEQ ID NO: 1344)

5'-GAUGAAGGAGAAGAUGGAGAUGAac-3'      (SEQ ID NO: 193)
                 3'-GUCUACUUCCUCUUCUACCUCUACUUG-5'    (SEQ ID NO: 769)
CKAP5-2647 Target:5'-CAGATGAAGGAGAAGATGGAGATGAAC-3'   (SEQ ID NO: 1345)

5'-GUUGAUCUUUUGCCGAGGACGGAga-3'      (SEQ ID NO: 194)
                 3'-AGCAACUAGAAAACGGCUCCUGCCUCU-5'    (SEQ ID NO: 770)
CKAP5-2695 Target:5'-TCGTTGATCTTTTGCCGAGGACGGAGA-3'   (SEQ ID NO: 1346)

5'-GGAAAGAAGGCCUAGAUGAAGUGgc-3'      (SEQ ID NO: 195)
                 3'-AUCCUUUCUUCCGGAUCUACUUCACCG-5'    (SEQ ID NO: 771)
CKAP5-2780 Target:5'-TAGGAAAGAAGGCCTAGATGAAGTGGC-3'   (SEQ ID NO: 1347)

5'-AAAGAAGGCCUAGAUGAAGUGGCag-3'      (SEQ ID NO: 196)
                 3'-CCUUUCUUCCGGAUCUACUUCACCGUC-5'    (SEQ ID NO: 772)
CKAP5-2782 Target:5'-GGAAAGAAGGCCTAGATGAAGTGGCAG-3'   (SEQ ID NO: 1348)

5'-AGAAGGCCUAGAUGAAGUGGCAGgt-3'      (SEQ ID NO: 197)
                 3'-UUUCUUCCGGAUCUACUUCACCGUCCA-5'    (SEQ ID NO: 773)
CKAP5-2784 Target:5'-AAAGAAGGCCTAGATGAAGTGGCAGGT-3'   (SEQ ID NO: 1349)

5'-AAGGCCUAGAUGAAGUGGCAGGUat-3'      (SEQ ID NO: 198)
                 3'-UCUUCCGGAUCUACUUCACCGUCCAUA-5'    (SEQ ID NO: 774)
CKAP5-2786 Target:5'-AGAAGGCCTAGATGAAGTGGCAGGTAT-3'   (SEQ ID NO: 1350)

5'-GGCCUAGAUGAAGUGGCAGGUAUta-3'      (SEQ ID NO: 199)
                 3'-UUCCGGAUCUACUUCACCGUCCAUAAU-5'    (SEQ ID NO: 775)
CKAP5-2788 Target:5'-AAGGCCTAGATGAAGTGGCAGGTATTA-3'   (SEQ ID NO: 1351)

5'-CCUAGAUGAAGUGGCAGGUAUUAtt-3'      (SEQ ID NO: 200)
                 3'-CCGGAUCUACUUCACCGUCCAUAAUAA-5'    (SEQ ID NO: 776)
CKAP5-2790 Target:5'-GGCCTAGATGAAGTGGCAGGTATTATT-3'   (SEQ ID NO: 1352)

5'-UAGAUGAAGUGGCAGGUAUUAUUaa-3'      (SEQ ID NO: 201)
                 3'-GGAUCUACUUCACCGUCCAUAAUAAUU-5'    (SEQ ID NO: 777)
CKAP5-2792 Target:5'-CCTAGATGAAGTGGCAGGTATTATTAA-3'  (SEQ ID NO: 1353)
```

TABLE 2-continued

Selected Human Anti-CKAP5 DsiRNA Agents (Asymmetrics)

```
                5'-GAUGAAGUGGCAGGUAUUAUUAAtg-3'      (SEQ ID NO: 202)
                3'-AUCUACUUCACCGUCCAUAAUAAUUAC-5'    (SEQ ID NO: 778)
CKAP5-2794 Target:5'-TAGATGAAGTGGCAGGTATTATTAATG-3'  (SEQ ID NO: 1354)

5'-AAUAUAGGUGAACUUCCAACUGCct-3'      (SEQ ID NO: 203)
                3'-GCUUAUAUCCACUUGAAGGUUGACGGA-5'    (SEQ ID NO: 779)
CKAP5-2839 Target:5'-CGAATATAGGTGAACTTCCAACTGCCT-3'  (SEQ ID NO: 1355)

5'-UAUAGGUGAACUUCCAACUGCCUtg-3'      (SEQ ID NO: 204)
                3'-UUAUAUCCACUUGAAGGUUGACGGAAC-5'    (SEQ ID NO: 780)
CKAP5-2841 Target:5'-AATATAGGTGAACTTCCAACTGCCTTG-3'  (SEQ ID NO: 1356)

5'-UAGGUGAACUUCCAACUGCCUUGaa-3'      (SEQ ID NO: 205)
                3'-AUAUCCACUUGAAGGUUGACGGAACUU-5'    (SEQ ID NO: 781)
CKAP5-2843 Target:5'-TATAGGTGAACTTCCAACTGCCTTGAA-3'  (SEQ ID NO: 1357)

5'-GGUGAACUUCCAACUGCCUUGAAgg-3'      (SEQ ID NO: 206)
                3'-AUCCACUUGAAGGUUGACGGAACUUCC-5'    (SEQ ID NO: 782)
CKAP5-2845 Target:5'-TAGGTGAACTTCCAACTGCCTTGAAGG-3'  (SEQ ID NO: 1358)

5'-UGAACUUCCAACUGCCUUGAAGGgt-3'      (SEQ ID NO: 207)
                3'-CCACUUGAAGGUUGACGGAACUUCCCA-5'    (SEQ ID NO: 783)
CKAP5-2847 Target:5'-GGTGAACTTCCAACTGCCTTGAAGGGT-3'  (SEQ ID NO: 1359)

5'-AACUUCCAACUGCCUUGAAGGGUcg-3'      (SEQ ID NO: 208)
                3'-ACUUGAAGGUUGACGGAACUUCCCAGC-5'    (SEQ ID NO: 784)
CKAP5-2849 Target:5'-TGAACTTCCAACTGCCTTGAAGGGTCG-3'  (SEQ ID NO: 1360)

5'-CUUCCAACUGCCUUGAAGGGUCGac-3'      (SEQ ID NO: 209)
                3'-UUGAAGGUUGACGGAACUUCCCAGCUG-5'    (SEQ ID NO: 785)
CKAP5-2851 Target:5'-AACTTCCAACTGCCTTGAAGGGTCGAC-3'  (SEQ ID NO: 1361)

5'-UCCAACUGCCUUGAAGGGUCGACtc-3'      (SEQ ID NO: 210)
                3'-GAAGGUUGACGGAACUUCCCAGCUGAG-5'    (SEQ ID NO: 786)
CKAP5-2853 Target:5'-CTTCCAACTGCCTTGAAGGGTCGACTC-3'  (SEQ ID NO: 1362)

5'-CAACUGCCUUGAAGGGUCGACUCaa-3'      (SEQ ID NO: 211)
                3'-AGGUUGACGGAACUUCCCAGCUGAGUU-5'    (SEQ ID NO: 787)
CKAP5-2855 Target:5'-TCCAACTGCCTTGAAGGGTCGACTCAA-3'  (SEQ ID NO: 1363)

5'-ACUGCCUUGAAGGGUCGACUCAAtg-3'      (SEQ ID NO: 212)
                3'-GUUGACGGAACUUCCCAGCUGAGUUAC-5'    (SEQ ID NO: 788)
CKAP5-2857 Target:5'-CAACTGCCTTGAAGGGTCGACTCAATG-3'  (SEQ ID NO: 1364)

5'-CAACUGGCAGUAGCCAUGGGCCCaa-3'      (SEQ ID NO: 213)
                3'-UUGUUGACCGUCAUCGGUACCCGGGUU-5'    (SEQ ID NO: 789)
CKAP5-2926 Target:5'-AACAACTGGCAGTAGCCATGGGCCCAA-3'  (SEQ ID NO: 1365)

5'-AGCAAGAACAAUGUUCGAGCUGCtg-3'      (SEQ ID NO: 214)
                3'-UGUCGUUCUUGUUACAAGCUCGACGAC-5'    (SEQ ID NO: 790)
CKAP5-3007 Target:5'-ACAGCAAGAACAATGTTCGAGCTGCTG-3'  (SEQ ID NO: 1366)

5'-CAAGAACAAUGUUCGAGCUGCUGcc-3'      (SEQ ID NO: 215)
                3'-UCGUUCUUGUUACAAGCUCGACGACGG-5'    (SEQ ID NO: 791)
CKAP5-3009 Target:5'-AGCAAGAACAATGTTCGAGCTGCTGCC-3'  (SEQ ID NO: 1367)

5'-AGAACAAUGUUCGAGCUGCUGCCct-3'      (SEQ ID NO: 216)
                3'-GUUCUUGUUACAAGCUCGACGACGGGA-5'    (SEQ ID NO: 792)
CKAP5-3011 Target:5'-CAAGAACAATGTTCGAGCTGCTGCCCT-3'  (SEQ ID NO: 1368)

5'-AACAAUGUUCGAGCUGCUGCCCUag-3'      (SEQ ID NO: 217)
                3'-UCUUGUUACAAGCUCGACGACGGGAUC-5'    (SEQ ID NO: 793)
CKAP5-3013 Target:5'-AGAACAATGTTCGAGCTGCTGCCCTAG-3'  (SEQ ID NO: 1369)

5'-CAAUGUUCGAGCUGCUGCCCUAGcg-3'      (SEQ ID NO: 218)
                3'-UUGUUACAAGCUCGACGACGGGAUCGC-5'    (SEQ ID NO: 794)
CKAP5-3015 Target:5'-AACAATGTTCGAGCTGCTGCCCTAGCG-3'  (SEQ ID NO: 1370)

5'-AUGUUCGAGCUGCUGCCCUAGCGac-3'      (SEQ ID NO: 219)
                3'-GUUACAAGCUCGACGACGGGAUCGCUG-5'    (SEQ ID NO: 795)
CKAP5-3017 Target:5'-CAATGTTCGAGCTGCTGCCCTAGCGAC-3'  (SEQ ID NO: 1371)

5'-GUUCGAGCUGCUGCCCUAGCGACtg-3'      (SEQ ID NO: 220)
                3'-UACAAGCUCGACGACGGGAUCGCUGAC-5'    (SEQ ID NO: 796)
CKAP5-3019 Target:5'-ATGTTCGAGCTGCTGCCCTAGCGACTG-3'  (SEQ ID NO: 1372)
```

TABLE 2-continued

Selected Human Anti-CKAP5 DsiRNA Agents (Asymmetrics)

```
                   5'-ACUGUGAAUGCUUGGGCAGAACAga-3'      (SEQ ID NO: 221)
                   3'-GCUGACACUUACGAACCCGUCUUGUCU-5'    (SEQ ID NO: 797)
CKAP5-3040 Target: 5'-CGACTGTGAATGCTTGGGCAGAACAGA-3'    (SEQ ID NO: 1373)

5'-UGUGAAUGCUUGGGCAGAACAGAct-3'      (SEQ ID NO: 222)
                   3'-UGACACUUACGAACCCGUCUUGUCUGA-5'    (SEQ ID NO: 798)
CKAP5-3042 Target: 5'-ACTGTGAATGCTTGGGCAGAACAGACT-3'    (SEQ ID NO: 1374)

5'-UGAAUGCUUGGGCAGAACAGACUgg-3'      (SEQ ID NO: 223)
                   3'-ACACUUACGAACCCGUCUUGUCUGACC-5'    (SEQ ID NO: 799)
CKAP5-3044 Target: 5'-TGTGAATGCTTGGGCAGAACAGACTGG-3'    (SEQ ID NO: 1375)

5'-GAGAAGAUCUUUCUGAAGAGCUCaa-3'      (SEQ ID NO: 224)
                   3'-UCCUCUUCUAGAAAGACUUCUCGAGUU-5'    (SEQ ID NO: 800)
CKAP5-3089 Target: 5'-AGGAGAAGATCTTTCTGAAGAGCTCAA-3'    (SEQ ID NO: 1376)

5'-CUAGAAGAUCGAAAUGGAGAUGUGc-3'      (SEQ ID NO: 225)
                   3'-CGGAUCUUCUAGCUUUACCUCUACACG-5'    (SEQ ID NO: 801)
CKAP5-3229 Target: 5'-GCCTAGAAGATCGAAATGGAGATGTGC-3'    (SEQ ID NO: 1377)

5'-AGAAGAUCGAAAUGGAGAUGUGCga-3'      (SEQ ID NO: 226)
                   3'-GAUCUUCUAGCUUUACCUCUACACGCU-5'    (SEQ ID NO: 802)
CKAP5-3231 Target: 5'-CTAGAAGATCGAAATGGAGATGTGCGA-3'    (SEQ ID NO: 1378)

5'-AAGAUCGAAAUGGAGAUGUGCGAaa-3'      (SEQ ID NO: 227)
                   3'-UCUUCUAGCUUUACCUCUACACGCUUU-5'    (SEQ ID NO: 803)
CKAP5-3233 Target: 5'-AGAAGATCGAAATGGAGATGTGCGAAA-3'    (SEQ ID NO: 1379)

5'-UGAUGCAUUUAGGAUAUGAAAAAat-3'      (SEQ ID NO: 228)
                   3'-GUACUACGUAAAUCCUAUACUUUUUUA-5'    (SEQ ID NO: 804)
CKAP5-3287 Target: 5'-CATGATGCATTTAGGATATGAAAAAAT-3'    (SEQ ID NO: 1380)

5'-AUGCAUUUAGGAUAUGAAAAAAUgg-3'      (SEQ ID NO: 229)
                   3'-ACUACGUAAAUCCUAUACUUUUUUACC-5'    (SEQ ID NO: 805)
CKAP5-3289 Target: 5'-TGATGCATTTAGGATATGAAAAAATGG-3'    (SEQ ID NO: 1381)

5'-GCAUUUAGGAUAUGAAAAAAUGGcc-3'      (SEQ ID NO: 230)
                   3'-UACGUAAAUCCUAUACUUUUUUACCGG-5'    (SEQ ID NO: 806)
CKAP5-3291 Target: 5'-ATGCATTTAGGATATGAAAAAATGGCC-3'    (SEQ ID NO: 1382)

5'-AUUUAGGAUAUGAAAAAAUGGCCaa-3'      (SEQ ID NO: 231)
                   3'-CGUAAAUCCUAUACUUUUUUACCGGUU-5'    (SEQ ID NO: 807)
CKAP5-3293 Target: 5'-GCATTTAGGATATGAAAAAATGGCCAA-3'    (SEQ ID NO: 1383)

5'-UUAGGAUAUGAAAAAAUGGCCAAgg-3'      (SEQ ID NO: 232)
                   3'-UAAAUCCUAUACUUUUUUACCGGUUCC-5'    (SEQ ID NO: 808)
CKAP5-3295 Target: 5'-ATTTAGGATATGAAAAAATGGCCAAGG-3'    (SEQ ID NO: 1384)

5'-AAGGCUACUGGGAAACUAAAGCCaa-3'      (SEQ ID NO: 233)
                   3'-GGUUCCGAUGACCCUUUGAUUUCGGUU-5'    (SEQ ID NO: 809)
CKAP5-3316 Target: 5'-CCAAGGCTACTGGGAAACTAAAGCCAA-3'    (SEQ ID NO: 1385)

5'-GGCUACUGGGAAACUAAAGCCAAct-3'      (SEQ ID NO: 234)
                   3'-UUCCGAUGACCCUUUGAUUUCGGUUGA-5'    (SEQ ID NO: 810)
CKAP5-3318 Target: 5'-AAGGCTACTGGGAAACTAAAGCCAACT-3'    (SEQ ID NO: 1386)

5'-CUACUGGGAAACUAAAGCCAACUtc-3'      (SEQ ID NO: 235)
                   3'-CCGAUGACCCUUUGAUUUCGGUUGAAG-5'    (SEQ ID NO: 811)
CKAP5-3320 Target: 5'-GGCTACTGGGAAACTAAAGCCAACTTC-3'    (SEQ ID NO: 1387)

5'-ACUGGGAAACUAAAGCCAACUUCta-3'      (SEQ ID NO: 236)
                   3'-GAUGACCCUUUGAUUUCGGUUGAAGAU-5'    (SEQ ID NO: 812)
CKAP5-3322 Target: 5'-CTACTGGGAAACTAAAGCCAACTTCTA-3'    (SEQ ID NO: 1388)

5'-UGGGAAACUAAAGCCAACUUCUAaa-3'      (SEQ ID NO: 237)
                   3'-UGACCCUUUGAUUUCGGUUGAAGAUUU-5'    (SEQ ID NO: 813)
CKAP5-3324 Target: 5'-ACTGGGAAACTAAAGCCAACTTCTAAA-3'    (SEQ ID NO: 1389)

5'-GGAAACUAAAGCCAACUUCUAAAga-3'      (SEQ ID NO: 238)
                   3'-ACCCUUUGAUUUCGGUUGAAGAUUUCU-5'    (SEQ ID NO: 814)
CKAP5-3326 Target: 5'-TGGGAAACTAAAGCCAACTTCTAAAGA-3'    (SEQ ID NO: 1390)

5'-AAACUAAAGCCAACUUCUAAAGAtc-3'      (SEQ ID NO: 239)
                   3'-CCUUUGAUUUCGGUUGAAGAUUUCUAG-5'    (SEQ ID NO: 815)
CKAP5-3328 Target: 5'-GGAAACTAAAGCCAACTTCTAAAGATC-3'    (SEQ ID NO: 1391)
```

TABLE 2-continued

Selected Human Anti-CKAP5 DsiRNA Agents (Asymmetrics)

```
                5'-ACUAAAGCCAACUUCUAAAGAUCag-3'      (SEQ ID NO: 240)
                3'-UUUGAUUUCGGUUGAAGAUUUCUAGUC-5'    (SEQ ID NO: 816)
CKAP5-3330 Target:5'-AAACTAAAGCCAACTTCTAAAGATCAG-3'  (SEQ ID NO: 1392)

5'-UAAAGCCAACUUCUAAAGAUCAGgt-3'      (SEQ ID NO: 241)
                3'-UGAUUUCGGUUGAAGAUUUCUAGUCCA-5'    (SEQ ID NO: 817)
CKAP5-3332 Target:5'-ACTAAAGCCAACTTCTAAAGATCAGGT-3'  (SEQ ID NO: 1393)

5'-AAGCCAACUUCUAAAGAUCAGGUat-3'      (SEQ ID NO: 242)
                3'-AUUUCGGUUGAAGAUUUCUAGUCCAUA-5'    (SEQ ID NO: 818)
CKAP5-3334 Target:5'-TAAAGCCAACTTCTAAAGATCAGGTAT-3'  (SEQ ID NO: 1394)

5'-CCUAUUUUUAUUGUUGUUCCAAAtg-3'      (SEQ ID NO: 243)
                3'-CCGGAUAAAAAUAACAACAAGGUUUAC-5'    (SEQ ID NO: 819)
CKAP5-3625 Target:5'-GGCCTATTTTTATTGTTGTTCCAAATG-3'  (SEQ ID NO: 1395)

5'-UAUUUUUAUUGUUGUUCCAAAUGga-3'      (SEQ ID NO: 244)
                3'-GGAUAAAAAUAACAACAAGGUUUACCU-5'    (SEQ ID NO: 820)
CKAP5-3627 Target:5'-CCTATTTTTATTGTTGTTCCAAATGGA-3'  (SEQ ID NO: 1396)

5'-UUUUUAUUGUUGUUCCAAAUGGAaa-3'      (SEQ ID NO: 245)
                3'-AUAAAAAUAACAACAAGGUUUACCUUU-5'    (SEQ ID NO: 821)
CKAP5-3629 Target:5'-TATTTTTATTGTTGTTCCAAATGGAAA-3'  (SEQ ID NO: 1397)

5'-UUUAUUGUUGUUCCAAAUGGAAAag-3'      (SEQ ID NO: 246)
                3'-AAAAAUAACAACAAGGUUUACCUUUUC-5'    (SEQ ID NO: 822)
CKAP5-3631 Target:5'-TTTTTATTGTTGTTCCAAATGGAAAAG-3'  (SEQ ID NO: 1398)

5'-UAUUGUUGUUCCAAAUGGAAAAGag-3'      (SEQ ID NO: 247)
                3'-AAAUAACAACAAGGUUUACCUUUUCUC-5'    (SEQ ID NO: 823)
CKAP5-3633 Target:5'-TTTATTGTTGTTCCAAATGGAAAAGAG-3'  (SEQ ID NO: 1399)

5'-UUGUUGUUCCAAAUGGAAAAGAGca-3'      (SEQ ID NO: 248)
                3'-AUAACAACAAGGUUUACCUUUUCUCGU-5'    (SEQ ID NO: 824)
CKAP5-3635 Target:5'-TATTGTTGTTCCAAATGGAAAAGAGCA-3'  (SEQ ID NO: 1400)

5'-AGGUGCUAAAGUGGAAUUUUACUac-3'      (SEQ ID NO: 249)
                3'-CUUCCACGAUUUCACCUUAAAAUGAUG-5'    (SEQ ID NO: 825)
CKAP5-3686 Target:5'-GAAGGTGCTAAAGTGGAATTTTACTAC-3'  (SEQ ID NO: 1401)

5'-GUGCUAAAGUGGAAUUUUACUACcc-3'      (SEQ ID NO: 250)
                3'-UCCACGAUUUCACCUUAAAAUGAUGGG-5'    (SEQ ID NO: 826)
CKAP5-3688 Target:5'-AGGTGCTAAAGTGGAATTTTACTACCC-3'  (SEQ ID NO: 1402)

5'-AUCAUCUUACUGAGAAUGAAGCAtc-3'      (SEQ ID NO: 251)
                3'-UAUAGUAGAAUGACUCUUACUUCGUAG-5'    (SEQ ID NO: 827)
CKAP5-3989 Target:5'-ATATCATCTTACTGAGAATGAAGCATC-3'  (SEQ ID NO: 1403)

5'-CAUCUUACUGAGAAUGAAGCAUCtt-3'      (SEQ ID NO: 252)
                3'-UAGUAGAAUGACUCUUACUUCGUAGAA-5'    (SEQ ID NO: 828)
CKAP5-3991 Target:5'-ATCATCTTACTGAGAATGAAGCATCTT-3'  (SEQ ID NO: 1404)

5'-UCUUACUGAGAAUGAAGCAUCUUcc-3'      (SEQ ID NO: 253)
                3'-GUAGAAUGACUCUUACUUCGUAGAAGG-5'    (SEQ ID NO: 829)
CKAP5-3993 Target:5'-CATCTTACTGAGAATGAAGCATCTTCC-3'  (SEQ ID NO: 1405)

5'-UUACUGAGAAUGAAGCAUCUUCCtt-3'      (SEQ ID NO: 254)
                3'-AGAAUGACUCUUACUUCGUAGAAGGAA-5'    (SEQ ID NO: 830)
CKAP5-3995 Target:5'-TCTTACTGAGAATGAAGCATCTTCCTT-3'  (SEQ ID NO: 1406)

5'-CAAGGUUGGAGAACCAAAGGAUGtc-3'      (SEQ ID NO: 255)
                3'-CAGUUCCAACCUCUUGGUUUCCUACAG-5'    (SEQ ID NO: 831)
CKAP5-4038 Target:5'-GTCAAGGTTGGAGAACCAAAGGATGTC-3'  (SEQ ID NO: 1407)

5'-AGGUUGGAGAACCAAAGGAUGUCat-3'      (SEQ ID NO: 256)
                3'-GUUCCAACCUCUUGGUUUCCUACAGUA-5'    (SEQ ID NO: 832)
CKAP5-4040 Target:5'-CAAGGTTGGAGAACCAAAGGATGTCAT-3'  (SEQ ID NO: 1408)

5'-GUUGGAGAACCAAAGGAUGUCAUtc-3'      (SEQ ID NO: 257)
                3'-UCCAACCUCUUGGUUUCCUACAGUAAG-5'    (SEQ ID NO: 833)
CKAP5-4042 Target:5'-AGGTTGGAGAACCAAAGGATGTCATTC-3'  (SEQ ID NO: 1409)

5'-UGGAGAACCAAAGGAUGUCAUUCgt-3'      (SEQ ID NO: 258)
                3'-CAACCUCUUGGUUUCCUACAGUAAGCA-5'    (SEQ ID NO: 834)
CKAP5-4044 Target:5'-GTTGGAGAACCAAAGGATGTCATTCGT-3'  (SEQ ID NO: 1410)
```

TABLE 2-continued

Selected Human Anti-CKAP5 DsiRNA Agents (Asymmetrics)

```
                 5'-GAGAACCAAAGGAUGUCAUUCGUaa-3'      (SEQ ID NO: 259)
                 3'-ACCUCUUGGUUUCCUACAGUAAGCAUU-5'    (SEQ ID NO: 835)
CKAP5-4046 Target:5'-TGGAGAACCAAAGGATGTCATTCGTAA-3'   (SEQ ID NO: 1411)

5'-GAACCAAAGGAUGUCAUUCGUAAag-3'      (SEQ ID NO: 260)
                 3'-CUCUUGGUUUCCUACAGUAAGCAUUUC-5'    (SEQ ID NO: 836)
CKAP5-4048 Target:5'-GAGAACCAAAGGATGTCATTCGTAAAG-3'   (SEQ ID NO: 1412)

5'-ACCAAAGGAUGUCAUUCGUAAAGat-3'      (SEQ ID NO: 261)
                 3'-CUUGGUUUCCUACAGUAAGCAUUUCUA-5'    (SEQ ID NO: 837)
CKAP5-4050 Target:5'-GAACCAAAGGATGTCATTCGTAAAGAT-3'   (SEQ ID NO: 1413)

5'-CAAAGGAUGUCAUUCGUAAAGAUgt-3'      (SEQ ID NO: 262)
                 3'-UGGUUUCCUACAGUAAGCAUUUCUACA-5'    (SEQ ID NO: 838)
CKAP5-4052 Target:5'-ACCAAAGGATGTCATTCGTAAAGATGT-3'   (SEQ ID NO: 1414)

5'-AAGGAUGUCAUUCGUAAAGAUGUtc-3'      (SEQ ID NO: 263)
                 3'-GUUUCCUACAGUAAGCAUUUCUACAAG-5'    (SEQ ID NO: 839)
CKAP5-4054 Target:5'-CAAAGGATGTCATTCGTAAAGATGTTC-3'   (SEQ ID NO: 1415)

5'-GGAUGUCAUUCGUAAAGAUGUUCgt-3'      (SEQ ID NO: 264)
                 3'-UUCCUACAGUAAGCAUUUCUACAAGCA-5'    (SEQ ID NO: 840)
CKAP5-4056 Target:5'-AAGGATGTCATTCGTAAAGATGTTCGT-3'   (SEQ ID NO: 1416)

5'-AUGUCAUUCGUAAAGAUGUUCGUgc-3'      (SEQ ID NO: 265)
                 3'-CCUACAGUAAGCAUUUCUACAAGCACG-5'    (SEQ ID NO: 841)
CKAP5-4058 Target:5'-GGATGTCATTCGTAAAGATGTTCGTGC-3'   (SEQ ID NO: 1417)

5'-UCCUGAACCGGAUGUGCCUUGUCta-3'      (SEQ ID NO: 266)
                 3'-GUAGGACUUGGCCUACACGGAACAGAU-5'    (SEQ ID NO: 842)
CKAP5-4085 Target:5'-CATCCTGAACCGGATGTGCCTTGTCTA-3'   (SEQ ID NO: 1418)

5'-CUGAACCGGAUGUGCCUUGUCUAcc-3'      (SEQ ID NO: 267)
                 3'-AGGACUUGGCCUACACGGAACAGAUGG-5'    (SEQ ID NO: 843)
CKAP5-4087 Target:5'-TCCTGAACCGGATGTGCCTTGTCTACC-3'   (SEQ ID NO: 1419)

5'-GAACCGGAUGUGCCUUGUCUACCca-3'      (SEQ ID NO: 268)
                 3'-GACUUGGCCUACACGGAACAGAUGGGU-5'    (SEQ ID NO: 844)
CKAP5-4089 Target:5'-CTGAACCGGATGTGCCTTGTCTACCCA-3'   (SEQ ID NO: 1420)

5'-ACCGGAUGUGCCUUGUCUACCCAgc-3'      (SEQ ID NO: 269)
                 3'-CUUGGCCUACACGGAACAGAUGGGUCG-5'    (SEQ ID NO: 845)
CKAP5-4091 Target:5'-GAACCGGATGTGCCTTGTCTACCCAGC-3'   (SEQ ID NO: 1421)

5'-CGGAUGUGCCUUGUCUACCCAGCta-3'      (SEQ ID NO: 270)
                 3'-UGGCCUACACGGAACAGAUGGGUCGAU-5'    (SEQ ID NO: 846)
CKAP5-4093 Target:5'-ACCGGATGTGCCTTGTCTACCCAGCTA-3'   (SEQ ID NO: 1422)

5'-GAUGUGCCUUGUCUACCCAGCUAgc-3'      (SEQ ID NO: 271)
                 3'-GCCUACACGGAACAGAUGGGUCGAUCG-5'    (SEQ ID NO: 847)
CKAP5-4095 Target:5'-CGGATGTGCCTTGTCTACCCAGCTAGC-3'   (SEQ ID NO: 1423)

5'-UGUGCCUUGUCUACCCAGCUAGCaa-3'      (SEQ ID NO: 272)
                 3'-CUACACGGAACAGAUGGGUCGAUCGUU-5'    (SEQ ID NO: 848)
CKAP5-4097 Target:5'-GATGTGCCTTGTCTACCCAGCTAGCAA-3'   (SEQ ID NO: 1424)

5'-CCAAAAACUCUAAGCAGAGAGCAga-3'      (SEQ ID NO: 273)
                 3'-UAGGUUUUGAGAUUCGUCUCUCGUCU-5'     (SEQ ID NO: 849)
CKAP5-4154 Target:5'-ATCCAAAAACTCTAAGCAGAGAGCAGA-3'   (SEQ ID NO: 1425)

5'-AAAAACUCUAAGCAGAGAGCAGAgt-3'      (SEQ ID NO: 274)
                 3'-GGUUUUGAGAUUCGUCUCUCGUCUCA-5'     (SEQ ID NO: 850)
CKAP5-4156 Target:5'-CCAAAAACTCTAAGCAGAGAGCAGAGT-3'   (SEQ ID NO: 1426)

5'-AAACUCUAAGCAGAGAGCAGAGUgc-3'      (SEQ ID NO: 275)
                 3'-UUUUUGAGAUUCGUCUCUCGUCUCACG-5'    (SEQ ID NO: 851)
CKAP5-4158 Target:5'-AAAAACTCTAAGCAGAGAGCAGAGTGC-3'   (SEQ ID NO: 1427)

5'-ACUCUAAGCAGAGAGCAGAGUGCct-3'      (SEQ ID NO: 276)
                 3'-UUUGAGAUUCGUCUCUCGUCUCACGGA-5'    (SEQ ID NO: 852)
CKAP5-4160 Target:5'-AAACTCTAAGCAGAGAGCAGAGTGCCT-3'   (SEQ ID NO: 1428)

5'-UCUAAGCAGAGAGCAGAGUGCCUgg-3'      (SEQ ID NO: 277)
                 3'-UGAGAUUCGUCUCUCGUCUCACGGACC-5'    (SEQ ID NO: 853)
CKAP5-4162 Target:5'-ACTCTAAGCAGAGAGCAGAGTGCCTGG-3'   (SEQ ID NO: 1429)
```

TABLE 2-continued

Selected Human Anti-CKAP5 DsiRNA Agents (Asymmetrics)

|  |  |  |
|---|---|---|
| | 5'-UAAGCAGAGAGCAGAGUGCCUGGaa-3' | (SEQ ID NO: 278) |
| | 3'-AGAUUCGUCUCUCGUCUCACGGACCUU-5' | (SEQ ID NO: 854) |
| CKAP5-4164 Target: | 5'-TCTAAGCAGAGAGCAGAGTGCCTGGAA-3' | (SEQ ID NO: 1430) |
| | 5'-AGCAGAGAGCAGAGUGCCUGGAAGa-3' | (SEQ ID NO: 279) |
| | 3'-AUUCGUCUCUCGUCUCACGGACCUUCU-5' | (SEQ ID NO: 855) |
| CKAP5-4166 Target: | 5'-TAAGCAGAGAGCAGAGTGCCTGGAAGA-3' | (SEQ ID NO: 1431) |
| | 5'-CAGAGAGCAGAGUGCCUGGAAGAGc-3' | (SEQ ID NO: 280) |
| | 3'-UCGUCUCUCGUCUCACGGACCUUCUCG-5' | (SEQ ID NO: 856) |
| CKAP5-4168 Target: | 5'-AGCAGAGAGCAGAGTGCCTGGAAGAGC-3' | (SEQ ID NO: 1432) |
| | 5'-GAGAGCAGAGUGCCUGGAAGAGCtg-3' | (SEQ ID NO: 281) |
| | 3'-GUCUCUCGUCUCACGGACCUUCUCGAC-5' | (SEQ ID NO: 857) |
| CKAP5-4170 Target: | 5'-CAGAGAGCAGAGTGCCTGGAAGAGCTG-3' | (SEQ ID NO: 1433) |
| | 5'-GAGCAGAGUGCCUGGAAGAGCUGgg-3' | (SEQ ID NO: 282) |
| | 3'-CUCUCGUCUCACGGACCUUCUCGACCC-5' | (SEQ ID NO: 858) |
| CKAP5-4172 Target: | 5'-GAGAGCAGAGTGCCTGGAAGAGCTGGG-3' | (SEQ ID NO: 1434) |
| | 5'-GCAGAGUGCCUGGAAGAGCUGGGat-3' | (SEQ ID NO: 283) |
| | 3'-CUCGUCUCACGGACCUUCUCGACCCUA-5' | (SEQ ID NO: 859) |
| CKAP5-4174 Target: | 5'-GAGCAGAGTGCCTGGAAGAGCTGGGAT-3' | (SEQ ID NO: 1435) |
| | 5'-CAGGAAAAGCCUUAAAGGAAAUAgc-3' | (SEQ ID NO: 284) |
| | 3'-GGGUCCUUUUCGGAAUUUCCUUUAUCG-5' | (SEQ ID NO: 860) |
| CKAP5-4241 Target: | 5'-CCCAGGAAAAGCCTTAAAGGAAATAGC-3' | (SEQ ID NO: 1436) |
| | 5'-AUCAGGUGUUCAAACUGAUUGGAaa-3' | (SEQ ID NO: 285) |
| | 3'-CCUAGUCCACAAGUUUGACUAACCUUU-5' | (SEQ ID NO: 861) |
| CKAP5-4346 Target: | 5'-GGATCAGGTGTTCAAACTGATTGGAAA-3' | (SEQ ID NO: 1437) |
| | 5'-CAGGUGUUCAAACUGAUUGGAAAtc-3' | (SEQ ID NO: 286) |
| | 3'-UAGUCCACAAGUUUGACUAACCUUUAG-5' | (SEQ ID NO: 862) |
| CKAP5-4348 Target: | 5'-ATCAGGTGTTCAAACTGATTGGAAATC-3' | (SEQ ID NO: 1438) |
| | 5'-GGUGUUCAAACUGAUUGGAAAUCtt-3' | (SEQ ID NO: 287) |
| | 3'-GUCCACAAGUUUGACUAACCUUUAGAA-5' | (SEQ ID NO: 863) |
| CKAP5-4350 Target: | 5'-CAGGTGTTCAAACTGATTGGAAATCTT-3' | (SEQ ID NO: 1439) |
| | 5'-UGUUCAAACUGAUUGGAAAUCUUtc-3' | (SEQ ID NO: 288) |
| | 3'-CCACAAGUUUGACUAACCUUUAGAAAG-5' | (SEQ ID NO: 864) |
| CKAP5-4352 Target: | 5'-GGTGTTCAAACTGATTGGAAATCTTTC-3' | (SEQ ID NO: 1440) |
| | 5'-UUCAAACUGAUUGGAAAUCUUUCtg-3' | (SEQ ID NO: 289) |
| | 3'-ACAAGUUUGACUAACCUUUAGAAAGAC-5' | (SEQ ID NO: 865) |
| CKAP5-4354 Target: | 5'-TGTTCAAACTGATTGGAAATCTTTCTG-3' | (SEQ ID NO: 1441) |
| | 5'-CAAACUGAUUGGAAAUCUUUCUGaa-3' | (SEQ ID NO: 290) |
| | 3'-AAGUUUGACUAACCUUUAGAAAGACUU-5' | (SEQ ID NO: 866) |
| CKAP5-4356 Target: | 5'-TTCAAACTGATTGGAAATCTTTCTGAA-3' | (SEQ ID NO: 1442) |
| | 5'-AACUGAUUGGAAAUCUUUCUGAAaa-3' | (SEQ ID NO: 291) |
| | 3'-GUUUGACUAACCUUUAGAAAGACUUUU-5' | (SEQ ID NO: 867) |
| CKAP5-4358 Target: | 5'-CAAACTGATTGGAAATCTTTCTGAAAA-3' | (SEQ ID NO: 1443) |
| | 5'-CUGAUUGGAAAUCUUUCUGAAAgg-3' | (SEQ ID NO: 292) |
| | 3'-UUGACUAACCUUUAGAAAGACUUUUCC-5' | (SEQ ID NO: 868) |
| CKAP5-4360 Target: | 5'-AACTGATTGGAAATCTTTCTGAAAAGG-3' | (SEQ ID NO: 1444) |
| | 5'-AAGCGGUCAGCAAAGAGACCCUCtg-3' | (SEQ ID NO: 293) |
| | 3'-AAUUCGCCAGUCGUUUCUCUGGGAGAC-5' | (SEQ ID NO: 869) |
| CKAP5-4411 Target: | 5'-TTAAGCGGTCAGCAAAGAGACCCTCTG-3' | (SEQ ID NO: 1445) |
| | 5'-GCGGUCAGCAAAGAGACCCUCUGct-3' | (SEQ ID NO: 294) |
| | 3'-UUCGCCAGUCGUUUCUCUGGGAGACGA-5' | (SEQ ID NO: 870) |
| CKAP5-4413 Target: | 5'-AAGCGGTCAGCAAAGAGACCCTCTGCT-3' | (SEQ ID NO: 1446) |
| | 5'-GGUCAGCAAAGAGACCCUCUGCUgc-3' | (SEQ ID NO: 295) |
| | 3'-CGCCAGUCGUUUCUCUGGGAGACGACG-5' | (SEQ ID NO: 871) |
| CKAP5-4415 Target: | 5'-GCGGTCAGCAAAGAGACCCTCTGCTGC-3' | (SEQ ID NO: 1447) |
| | 5'-UCAGCAAAGAGACCCUCUGCUGCac-3' | (SEQ ID NO: 296) |
| | 3'-CCAGUCGUUUCUCUGGGAGACGACGUG-5' | (SEQ ID NO: 872) |
| CKAP5-4417 Target: | 5'-GGTCAGCAAAGAGACCCTCTGCTGCAC-3' | (SEQ ID NO: 1448) |

TABLE 2-continued

Selected Human Anti-CKAP5 DsiRNA Agents (Asymmetrics)

|  |  |  |
|---|---|---|
| CKAP5-4419 | 5'-AGCAAAGAGACCCUCUGCUGCACCca-3'<br>3'-<u>AGUCG</u>UUUCUCUGGG<u>AGA</u>CGACGU<u>GGU</u>-5'<br>Target: 5'-TCAGCAAAGAGACCCTCTGCTGCACCA-3' | (SEQ ID NO: 297)<br>(SEQ ID NO: 873)<br>(SEQ ID NO: 1449) |
| CKAP5-4421 | 5'-CAAAGAGACCCUCUGCUGCACCAat-3'<br>3'-<u>UCGU</u>UUCUCUGGG<u>AGA</u>CGACGUGG<u>UUA</u>-5'<br>Target: 5'-AGCAAAGAGACCCTCTGCTGCACCAAT-3' | (SEQ ID NO: 298)<br>(SEQ ID NO: 874)<br>(SEQ ID NO: 1450) |
| CKAP5-4423 | 5'-AAGAGACCCUCUGCUGCACCAAUaa-3'<br>3'-<u>GUUU</u>CUCUGGGAGA<u>CGA</u>CGUGG<u>UUAUU</u>-5'<br>Target: 5'-CAAAGAGACCCTCTGCTGCACCAATAA-3' | (SEQ ID NO: 299)<br>(SEQ ID NO: 875)<br>(SEQ ID NO: 1451) |
| CKAP5-4505 | 5'-UACGCAAGGGACCAGCUGAGGACat-3'<br>3'-<u>CAAU</u>GCGUUCCCUGG<u>UCGA</u>CUCC<u>UGUA</u>-5'<br>Target: 5'-GTTACGCAAGGGACCAGCTGAGGACAT-3' | (SEQ ID NO: 300)<br>(SEQ ID NO: 876)<br>(SEQ ID NO: 1452) |
| CKAP5-4507 | 5'-CGCAAGGGACCAGCUGAGGACAUgt-3'<br>3'-<u>AUGC</u>GUUCCCUGGUC<u>GA</u>CUCCUG<u>UACA</u>-5'<br>Target: 5'-TACGCAAGGGACCAGCTGAGGACATGT-3' | (SEQ ID NO: 301)<br>(SEQ ID NO: 877)<br>(SEQ ID NO: 1453) |
| CKAP5-4591 | 5'-CGCCGAGAAUUCCAGCUGGAUCUag-3'<br>3'-<u>AGGC</u>GGCUCUUAAGG<u>UCGA</u>CCUA<u>GAUC</u>-5'<br>Target: 5'-TCCGCCGAGAATTCCAGCTGGATCTAG-3' | (SEQ ID NO: 302)<br>(SEQ ID NO: 878)<br>(SEQ ID NO: 1454) |
| CKAP5-4593 | 5'-CCGAGAAUUCCAGCUGGAUCUAGat-3'<br>3'-<u>GCGG</u>CUCUUAAGGUC<u>GA</u>CCUAGA<u>UCUA</u>-5'<br>Target: 5'-CGCCGAGAATTCCAGCTGGATCTAGAT-3' | (SEQ ID NO: 303)<br>(SEQ ID NO: 879)<br>(SEQ ID NO: 1455) |
| CKAP5-4718 | 5'-AGAUCCGGGCUGUUUCUCCACACtt-3'<br>3'-<u>GUUC</u>UAGGCCCGAC<u>AAA</u>GAGGUG<u>UGAA</u>-5'<br>Target: 5'-CAAGATCCGGGCTGTTTCTCCACACTT-3' | (SEQ ID NO: 304)<br>(SEQ ID NO: 880)<br>(SEQ ID NO: 1456) |
| CKAP5-4720 | 5'-AUCCGGGCUGUUUCUCCACACUUcg-3'<br>3'-<u>UCUA</u>GGCCCGACAAA<u>GA</u>GGUGUG<u>AAGC</u>-5'<br>Target: 5'-AGATCCGGGCTGTTTCTCCACACTTCG-3' | (SEQ ID NO: 305)<br>(SEQ ID NO: 881)<br>(SEQ ID NO: 1457) |
| CKAP5-4744 | 5'-GAUGACAUGCACAGUAAUACAGCat-3'<br>3'-<u>AGCU</u>ACUGUACGUGU<u>C</u>AUUAUGU<u>CGUA</u>-5'<br>Target: 5'-TCGATGACATGCACAGTAATACAGCAT-3' | (SEQ ID NO: 306)<br>(SEQ ID NO: 882)<br>(SEQ ID NO: 1458) |
| CKAP5-4746 | 5'-UGACAUGCACAGUAAUACAGCAUcc-3'<br>3'-<u>CUAC</u>UGUACGUGUC<u>A</u>UUAUGUCG<u>UAGG</u>-5'<br>Target: 5'-GATGACATGCACAGTAATACAGCATCC-3' | (SEQ ID NO: 307)<br>(SEQ ID NO: 883)<br>(SEQ ID NO: 1459) |
| CKAP5-4748 | 5'-ACAUGCACAGUAAUACAGCAUCCac-3'<br>3'-<u>ACUG</u>UACGUGUCAUU<u>A</u>UGUCGUA<u>GGUG</u>-5'<br>Target: 5'-TGACATGCACAGTAATACAGCATCCAC-3' | (SEQ ID NO: 308)<br>(SEQ ID NO: 884)<br>(SEQ ID NO: 1460) |
| CKAP5-4750 | 5'-AUGCACAGUAAUACAGCAUCCACaa-3'<br>3'-<u>UGUAC</u>GUGUCAUUAU<u>GU</u>CGUAGG<u>UGUU</u>-5'<br>Target: 5'-ACATGCACAGTAATACAGCATCCACAA-3' | (SEQ ID NO: 309)<br>(SEQ ID NO: 885)<br>(SEQ ID NO: 1461) |
| CKAP5-4752 | 5'-GCACAGUAAUACAGCAUCCACAAtc-3'<br>3'-<u>UACG</u>UGUCAUUAUGU<u>CG</u>UAGGUG<u>UUAG</u>-5'<br>Target: 5'-ATGCACAGTAATACAGCATCCACAATC-3' | (SEQ ID NO: 310)<br>(SEQ ID NO: 886)<br>(SEQ ID NO: 1462) |
| CKAP5-4754 | 5'-ACAGUAAUACAGCAUCCACAAUCaa-3'<br>3'-<u>CGUG</u>UCAUUAUGUC<u>G</u>UAGGUGUU<u>AGUU</u>-5'<br>Target: 5'-GCACAGTAATACAGCATCCACAATCAA-3' | (SEQ ID NO: 311)<br>(SEQ ID NO: 887)<br>(SEQ ID NO: 1463) |
| CKAP5-4756 | 5'-AGUAAUACAGCAUCCACAAUCAtt-3'<br>3'-<u>UGUC</u>AUUAUGUCGU<u>A</u>GGUGUUAG<u>UUAA</u>-5'<br>Target: 5'-ACAGTAATACAGCATCCACAATCAATT-3' | (SEQ ID NO: 312)<br>(SEQ ID NO: 888)<br>(SEQ ID NO: 1464) |
| CKAP5-4758 | 5'-UAAUACAGCAUCCACAAUCAAUUtc-3'<br>3'-<u>UCAU</u>UAUGUCGUAGG<u>U</u>GUUAGUU<u>AAAG</u>-5'<br>Target: 5'-AGTAATACAGCATCCACAATCAATTTC-3' | (SEQ ID NO: 313)<br>(SEQ ID NO: 889)<br>(SEQ ID NO: 1465) |
| CKAP5-4760 | 5'-AUACAGCAUCCACAAUCAAUUUCat-3'<br>3'-<u>AUUA</u>UGUCGUAGGUG<u>U</u>UAGUUAA<u>AGUA</u>-5'<br>Target: 5'-TAATACAGCATCCACAATCAATTTCAT-3' | (SEQ ID NO: 314)<br>(SEQ ID NO: 890)<br>(SEQ ID NO: 1466) |
| CKAP5-4762 | 5'-ACAGCAUCCACAAUCAAUUUCAUta-3'<br>3'-<u>UAUG</u>UCGUAGGUGUU<u>A</u>GUUAAAG<u>UAAU</u>-5'<br>Target: 5'-ATACAGCATCCACAATCAATTTCATTA-3' | (SEQ ID NO: 315)<br>(SEQ ID NO: 891)<br>(SEQ ID NO: 1467) |

TABLE 2-continued

Selected Human Anti-CKAP5 DsiRNA Agents (Asymmetrics)

```
                 5'-AGCAUCCACAAUCAAUUUCAUUAUc-3'       (SEQ ID NO: 316)
                 3'-UGUCGUAGGUGUUAGUUAAAGUAAUAG-5'     (SEQ ID NO: 892)
CKAP5-4764 Target:5'-ACAGCATCCACAATCAATTTCATTATC-3'    (SEQ ID NO: 1468)

5'-CAUCCACAAUCAAUUUCAUUAUCUc-3'       (SEQ ID NO: 317)
                 3'-UCGUAGGUGUUAGUUAAAGUAAUAGAG-5'     (SEQ ID NO: 893)
CKAP5-4766 Target:5'-AGCATCCACAATCAATTTCATTATCTC-3'    (SEQ ID NO: 1469)

5'-UCCACAAUCAAUUUCAUUAUCUCCc-3'       (SEQ ID NO: 318)
                 3'-GUAGGUGUUAGUUAAAGUAAUAGAGGG-5'     (SEQ ID NO: 894)
CKAP5-4768 Target:5'-CATCCACAATCAATTTCATTATCTCCC-3'    (SEQ ID NO: 1470)

5'-CACAAUCAAUUUCAUUAUCUCCCaa-3'       (SEQ ID NO: 319)
                 3'-AGGUGUUAGUUAAAGUAAUAGAGGGUU-5'     (SEQ ID NO: 895)
CKAP5-4770 Target:5'-TCCACAATCAATTTCATTATCTCCCAA-3'    (SEQ ID NO: 1471)

5'-CAAUCAAUUUCAUUAUCUCCCAAgt-3'       (SEQ ID NO: 320)
                 3'-GUGUUAGUUAAAGUAAUAGAGGGUUCA-5'     (SEQ ID NO: 896)
CKAP5-4772 Target:5'-CACAATCAATTTCATTATCTCCCAAGT-3'    (SEQ ID NO: 1472)

5'-AUCAAUUUCAUUAUCUCCCAAGUag-3'       (SEQ ID NO: 321)
                 3'-GUUAGUUAAAGUAAUAGAGGGUUCAUC-5'     (SEQ ID NO: 897)
CKAP5-4774 Target:5'-CAATCAATTTCATTATCTCCCAAGTAG-3'    (SEQ ID NO: 1473)

5'-CAAUUUCAUUAUCUCCCAAGUAGcc-3'       (SEQ ID NO: 322)
                 3'-UAGUUAAAGUAAUAGAGGGUUCAUCGG-5'     (SEQ ID NO: 898)
CKAP5-4776 Target:5'-ATCAATTTCATTATCTCCCAAGTAGCC-3'    (SEQ ID NO: 1474)

5'-AUUUCAUUAUCUCCCAAGUAGCCag-3'       (SEQ ID NO: 323)
                 3'-GUUAAAGUAAUAGAGGGUUCAUCGGUC-5'     (SEQ ID NO: 899)
CKAP5-4778 Target:5'-CAATTTCATTATCTCCCAAGTAGCCAG-3'    (SEQ ID NO: 1475)

5'-UUCAUUAUCUCCCAAGUAGCCAGtg-3'       (SEQ ID NO: 324)
                 3'-UAAAGUAAUAGAGGGUUCAUCGGUCAC-5'     (SEQ ID NO: 900)
CKAP5-4780 Target:5'-ATTTCATTATCTCCCAAGTAGCCAGTG-3'    (SEQ ID NO: 1476)

5'-CAUUAUCUCCCAAGUAGCCAGUGgt-3'       (SEQ ID NO: 325)
                 3'-AAGUAAUAGAGGGUUCAUCGGUCACCA-5'     (SEQ ID NO: 901)
CKAP5-4782 Target:5'-TTCATTATCTCCCAAGTAGCCAGTGGT-3'    (SEQ ID NO: 1477)

5'-UUAUCUCCCAAGUAGCCAGUGGUga-3'       (SEQ ID NO: 326)
                 3'-GUAAUAGAGGGUUCAUCGGUCACCACU-5'     (SEQ ID NO: 902)
CKAP5-4784 Target:5'-CATTATCTCCCAAGTAGCCAGTGGTGA-3'    (SEQ ID NO: 1478)

5'-AUCUCCCAAGUAGCCAGUGGUGAca-3'       (SEQ ID NO: 327)
                 3'-AAUAGAGGGUUCAUCGGUCACCACUGU-5'     (SEQ ID NO: 903)
CKAP5-4786 Target:5'-TTATCTCCCAAGTAGCCAGTGGTGACA-3'    (SEQ ID NO: 1479)

5'-CUCCCAAGUAGCCAGUGGUGACAtc-3'       (SEQ ID NO: 328)
                 3'-UAGAGGGUUCAUCGGUCACCACUGUAG-5'     (SEQ ID NO: 904)
CKAP5-4788 Target:5'-ATCTCCCAAGTAGCCAGTGGTGACATC-3'    (SEQ ID NO: 1480)

5'-CCCAAGUAGCCAGUGGUGACAUCaa-3'       (SEQ ID NO: 329)
                 3'-GAGGGUUCAUCGGUCACCACUGUAGUU-5'     (SEQ ID NO: 905)
CKAP5-4790 Target:5'-CTCCCAAGTAGCCAGTGGTGACATCAA-3'    (SEQ ID NO: 1481)

5'-CAAGUAGCCAGUGGUGACAUCAAca-3'       (SEQ ID NO: 330)
                 3'-GGGUUCAUCGGUCACCACUGUAGUUGU-5'     (SEQ ID NO: 906)
CKAP5-4792 Target:5'-CCCAAGTAGCCAGTGGTGACATCAACA-3'    (SEQ ID NO: 1482)

5'-GCCCGGGAGGCCUCCACUGGAGUAc-3'       (SEQ ID NO: 331)
                 3'-AACGGGCCCUCCGGAGGUGACCUCAUG-5'     (SEQ ID NO: 907)
CKAP5-5041 Target:5'-TTGCCCGGGAGGCCTCCACTGGAGTAC-3'    (SEQ ID NO: 1483)

5'-CCGGGAGGCCUCCACUGGAGUACta-3'       (SEQ ID NO: 332)
                 3'-CGGGCCCUCCGGAGGUGACCUCAUGAU-5'     (SEQ ID NO: 908)
CKAP5-5043 Target:5'-GCCCGGGAGGCCTCCACTGGAGTACTA-3'    (SEQ ID NO: 1484)

5'-GGGAGGCCUCCACUGGAGUACUAaa-3'       (SEQ ID NO: 333)
                 3'-GGCCCUCCGGAGGUGACCUCAUGAUUU-5'     (SEQ ID NO: 909)
CKAP5-5045 Target:5'-CCGGGAGGCCTCCACTGGAGTACTAAA-3'    (SEQ ID NO: 1485)

5'-GAGGCCUCCACUGGAGUACUAAAag-3'       (SEQ ID NO: 334)
                 3'-CCCUCCGGAGGUGACCUCAUGAUUUUC-5'     (SEQ ID NO: 910)
CKAP5-5047 Target:5'-GGGAGGCCTCCACTGGAGTACTAAAAG-3'    (SEQ ID NO: 1486)
```

TABLE 2-continued

Selected Human Anti-CKAP5 DsiRNA Agents (Asymmetrics)

|  |  |  |
|---|---|---|
| | 5'-AUCACCUUAAUGCUGGAUUCUCGga-3' | (SEQ ID NO: 335) |
| | 3'-AGUAGUGGAAUUACGACCUAAGAGCCU-5' | (SEQ ID NO: 911) |
| CKAP5-5089 Target: | 5'-TCATCACCTTAATGCTGGATTCTCGGA-3' | (SEQ ID NO: 1487) |
| | 5'-CACCUUAAUGCUGGAUUCUCGGAtt-3' | (SEQ ID NO: 336) |
| | 3'-UAGUGGAAUUACGACCUAAGAGCCUAA-5' | (SEQ ID NO: 912) |
| CKAP5-5091 Target: | 5'-ATCACCTTAATGCTGGATTCTCGGATT-3' | (SEQ ID NO: 1488) |
| | 5'-CCUUAAUGCUGGAUUCUCGGAUUga-3' | (SEQ ID NO: 337) |
| | 3'-GUGGAAUUACGACCUAAGAGCCUAACU-5' | (SEQ ID NO: 913) |
| CKAP5-5093 Target: | 5'-CACCTTAATGCTGGATTCTCGGATTGA-3' | (SEQ ID NO: 1489) |
| | 5'-UUAAUGCUGGAUUCUCGGAUUGAag-3' | (SEQ ID NO: 338) |
| | 3'-GGAAUUACGACCUAAGAGCCUAACUUC-5' | (SEQ ID NO: 914) |
| CKAP5-5095 Target: | 5'-CCTTAATGCTGGATTCTCGGATTGAAG-3' | (SEQ ID NO: 1490) |
| | 5'-AAUGCUGGAUUCUCGGAUUGAAGat-3' | (SEQ ID NO: 339) |
| | 3'-AAUUACGACCUAAGAGCCUAACUUCUA-5' | (SEQ ID NO: 915) |
| CKAP5-5097 Target: | 5'-TTAATGCTGGATTCTCGGATTGAAGAT-3' | (SEQ ID NO: 1491) |
| | 5'-UGCUGGAUUCUCGGAUUGAAGAUct-3' | (SEQ ID NO: 340) |
| | 3'-UUACGACCUAAGAGCCUAACUUCUAGA-5' | (SEQ ID NO: 916) |
| CKAP5-5099 Target: | 5'-AATGCTGGATTCTCGGATTGAAGATCT-3' | (SEQ ID NO: 1492) |
| | 5'-CUGGAUUCUCGGAUUGAAGAUCUtg-3' | (SEQ ID NO: 341) |
| | 3'-ACGACCUAAGAGCCUAACUUCUAGAAC-5' | (SEQ ID NO: 917) |
| CKAP5-5101 Target: | 5'-TGCTGGATTCTCGGATTGAAGATCTTG-3' | (SEQ ID NO: 1493) |
| | 5'-GGAUUCUCGGAUUGAAGAUCUUGag-3' | (SEQ ID NO: 342) |
| | 3'-GACCUAAGAGCCUAACUUCUAGAACUC-5' | (SEQ ID NO: 918) |
| CKAP5-5103 Target: | 5'-CTGGATTCTCGGATTGAAGATCTTGAG-3' | (SEQ ID NO: 1494) |
| | 5'-AUUCUCGGAUUGAAGAUCUUGAGga-3' | (SEQ ID NO: 343) |
| | 3'-CCUAAGAGCCUAACUUCUAGAACUCCU-5' | (SEQ ID NO: 919) |
| CKAP5-5105 Target: | 5'-GGATTCTCGGATTGAAGATCTTGAGGA-3' | (SEQ ID NO: 1495) |
| | 5'-CUGUGAACCUCUUGGUGGUGAAGgt-3' | (SEQ ID NO: 344) |
| | 3'-GAGACACUUGGAGAACCACCACUUCCA-5' | (SEQ ID NO: 920) |
| CKAP5-5150 Target: | 5'-CTCTGTGAACCTCTTGGTGGTGAAGGT-3' | (SEQ ID NO: 1496) |
| | 5'-GUGAACCUCUUGGUGGUGAAGGUtc-3' | (SEQ ID NO: 345) |
| | 3'-GACACUUGGAGAACCACCACUUCCAAG-5' | (SEQ ID NO: 921) |
| CKAP5-5152 Target: | 5'-CTGTGAACCTCTTGGTGGTGAAGGTTC-3' | (SEQ ID NO: 1497) |
| | 5'-GAACCUCUUGGUGGUGAAGGUUCtg-3' | (SEQ ID NO: 346) |
| | 3'-CACUUGGAGAACCACCACUUCCAAGAC-5' | (SEQ ID NO: 922) |
| CKAP5-5154 Target: | 5'-GTGAACCTCTTGGTGGTGAAGGTTCTG-3' | (SEQ ID NO: 1498) |
| | 5'-ACCUCUUGGUGGUGAAGGUUCUGga-3' | (SEQ ID NO: 347) |
| | 3'-CUUGGAGAACCACCACUUCCAAGACCU-5' | (SEQ ID NO: 923) |
| CKAP5-5156 Target: | 5'-GAACCTCTTGGTGGTGAAGGTTCTGGA-3' | (SEQ ID NO: 1499) |
| | 5'-GACAGCCUGCUAGCAACAGCCAGtt-3' | (SEQ ID NO: 348) |
| | 3'-UUCUGUCGGACGAUCGUUGUCGGUCAA-5' | (SEQ ID NO: 924) |
| CKAP5-5230 Target: | 5'-AAGACAGCCTGCTAGCAACAGCCAGTT-3' | (SEQ ID NO: 1500) |
| | 5'-AGUUCUCCCAAAUUCUCAGAGCUtg-3' | (SEQ ID NO: 349) |
| | 3'-GGUCAAGAGGGUUUAAGAGUCUCGAAC-5' | (SEQ ID NO: 925) |
| CKAP5-5251 Target: | 5'-CCAGTTCTCCCAAATTCTCAGAGCTTG-3' | (SEQ ID NO: 1501) |
| | 5'-UUCUCCCAAAUUCUCAGAGCUUGtt-3' | (SEQ ID NO: 350) |
| | 3'-UCAAGAGGGUUUAAGAGUCUCGAACAA-5' | (SEQ ID NO: 926) |
| CKAP5-5253 Target: | 5'-AGTTCTCCCAAATTCTCAGAGCTTGTT-3' | (SEQ ID NO: 1502) |
| | 5'-CUCCCAAAUUCUCAGAGCUUGUUat-3' | (SEQ ID NO: 351) |
| | 3'-AAGAGGGUUUAAGAGUCUCGAACAAUA-5' | (SEQ ID NO: 927) |
| CKAP5-5255 Target: | 5'-TTCTCCCAAATTCTCAGAGCTTGTTAT-3' | (SEQ ID NO: 1503) |
| | 5'-CCCAAAUUCUCAGAGCUUGUUAUga-3' | (SEQ ID NO: 352) |
| | 3'-GAGGGUUUAAGAGUCUCGAACAAUACU-5' | (SEQ ID NO: 928) |
| CKAP5-5257 Target: | 5'-CTCCCAAATTCTCAGAGCTTGTTATGA-3' | (SEQ ID NO: 1504) |
| | 5'-CAAAUUCUCAGAGCUUGUUAUGAag-3' | (SEQ ID NO: 353) |
| | 3'-GGGUUUAAGAGUCUCGAACAAUACUUC-5' | (SEQ ID NO: 929) |
| CKAP5-5259 Target: | 5'-CCCAAATTCTCAGAGCTTGTTATGAAG-3' | (SEQ ID NO: 1505) |

TABLE 2-continued

Selected Human Anti-CKAP5 DsiRNA Agents (Asymmetrics)

```
                 5'-AAUUCUCAGAGCUUGUUAUGAAGtg-3'      (SEQ ID NO: 354)
                 3'-GUUUAAGAGUCUCGAACAAUACUUCAC-5'    (SEQ ID NO: 930)
CKAP5-5261 Target:5'-CAAATTCTCAGAGCTTGTTATGAAGTG-3'   (SEQ ID NO: 1506)

5'-UUCUCAGAGCUUGUUAUGAAGUGtc-3'      (SEQ ID NO: 355)
                 3'-UUAAGAGUCUCGAACAAUACUUCACAG-5'    (SEQ ID NO: 931)
CKAP5-5263 Target:5'-AATTCTCAGAGCTTGTTATGAAGTGTC-3'   (SEQ ID NO: 1507)

5'-CUCAGAGCUUGUUAUGAAGUGUCtc-3'      (SEQ ID NO: 356)
                 3'-AAGAGUCUCGAACAAUACUUCACAGAG-5'    (SEQ ID NO: 932)
CKAP5-5265 Target:5'-TTCTCAGAGCTTGTTATGAAGTGTCTC-3'   (SEQ ID NO: 1508)

5'-CAGAGCUUGUUAUGAAGUGUCUCtg-3'      (SEQ ID NO: 357)
                 3'-GAGUCUCGAACAAUACUUCACAGAGAC-5'    (SEQ ID NO: 933)
CKAP5-5267 Target:5'-CTCAGAGCTTGTTATGAAGTGTCTCTG-3'   (SEQ ID NO: 1509)

5'-GAGCUUGUUAUGAAGUGUCUCUGga-3'      (SEQ ID NO: 358)
                 3'-GUCUCGAACAAUACUUCACAGAGACCU-5'    (SEQ ID NO: 934)
CKAP5-5269 Target:5'-CAGAGCTTGTTATGAAGTGTCTCTGGA-3'   (SEQ ID NO: 1510)

5'-AGCAUUAACCUAGACAGAAUUCUtc-3'      (SEQ ID NO: 359)
                 3'-UAUCGUAAUUGGAUCUGUCUUAAGAAG-5'    (SEQ ID NO: 935)
CKAP5-5326 Target:5'-ATAGCATTAACCTAGACAGAATTCTTC-3'   (SEQ ID NO: 1511)

5'-CAUUAACCUAGACAGAAUUCUUCtg-3'      (SEQ ID NO: 360)
                 3'-UCGUAAUUGGAUCUGUCUUAAGAAGAC-5'    (SEQ ID NO: 936)
CKAP5-5328 Target:5'-AGCATTAACCTAGACAGAATTCTTCTG-3'   (SEQ ID NO: 1512)

5'-UUAACCUAGACAGAAUUCUUCUGga-3'      (SEQ ID NO: 361)
                 3'-GUAAUUGGAUCUGUCUUAAGAAGACCU-5'    (SEQ ID NO: 937)
CKAP5-5330 Target:5'-CATTAACCTAGACAGAATTCTTCTGGA-3'   (SEQ ID NO: 1513)

5'-AACCUAGACAGAAUUCUUCUGGAta-3'      (SEQ ID NO: 362)
                 3'-AAUUGGAUCUGUCUUAAGAAGACCUAU-5'    (SEQ ID NO: 938)
CKAP5-5332 Target:5'-TTAACCTAGACAGAATTCTTCTGGATA-3'   (SEQ ID NO: 1514)

5'-CCUAGACAGAAUUCUUCUGGAUAtc-3'      (SEQ ID NO: 363)
                 3'-UUGGAUCUGUCUUAAGAAGACCUAUAG-5'    (SEQ ID NO: 939)
CKAP5-5334 Target:5'-AACCTAGACAGAATTCTTCTGGATATC-3'   (SEQ ID NO: 1515)

5'-UAGACAGAAUUCUUCUGGAUAUCca-3'      (SEQ ID NO: 364)
                 3'-GGAUCUGUCUUAAGAAGACCUAUAGGU-5'    (SEQ ID NO: 940)
CKAP5-5336 Target:5'-CCTAGACAGAATTCTTCTGGATATCCA-3'   (SEQ ID NO: 1516)

5'-UCCACAUUUUCAUGAAGGUCUUCcc-3'      (SEQ ID NO: 365)
                 3'-AUAGGUGUAAAAGUACUUCCAGAAGGG-5'    (SEQ ID NO: 941)
CKAP5-5357 Target:5'-TATCCACATTTTCATGAAGGTCTTCCC-3'   (SEQ ID NO: 1517)

5'-GAAGCAAUGCAAAAGUGAAUUUCcc-3'      (SEQ ID NO: 366)
                 3'-GACUUCGUUACGUUUUCACUUAAAGGG-5'    (SEQ ID NO: 942)
CKAP5-5394 Target:5'-CTGAAGCAATGCAAAAGTGAATTTCCC-3'   (SEQ ID NO: 1518)

5'-AGCAAUGCAAAAGUGAAUUUCCCat-3'      (SEQ ID NO: 367)
                 3'-CUUCGUUACGUUUUCACUUAAAGGGUA-5'    (SEQ ID NO: 943)
CKAP5-5396 Target:5'-GAAGCAATGCAAAAGTGAATTTCCCAT-3'   (SEQ ID NO: 1519)

5'-CAAUGCAAAAGUGAAUUUCCCAUaa-3'      (SEQ ID NO: 368)
                 3'-UCGUUACGUUUUCACUUAAAGGGUAUU-5'    (SEQ ID NO: 944)
CKAP5-5398 Target:5'-AGCAATGCAAAAGTGAATTTCCCATAA-3'   (SEQ ID NO: 1520)

5'-AGUAUGGACCAGACUGGGAGCAAgt-3'      (SEQ ID NO: 369)
                 3'-UGUCAUACCUGGUCUGACCCUCGUUCA-5'    (SEQ ID NO: 945)
CKAP5-5551 Target:5'-ACAGTATGGACCAGACTGGGAGCAAGT-3'   (SEQ ID NO: 1521)

5'-UAUGGACCAGACUGGGAGCAAGUct-3'      (SEQ ID NO: 370)
                 3'-UCAUACCUGGUCUGACCCUCGUUCAGA-5'    (SEQ ID NO: 946)
CKAP5-5553 Target:5'-AGTATGGACCAGACTGGGAGCAAGTCT-3'   (SEQ ID NO: 1522)

5'-UGGACCAGACUGGGAGCAAGUCUga-3'      (SEQ ID NO: 371)
                 3'-AUACCUGGUCUGACCCUCGUUCAGACU-5'    (SEQ ID NO: 947)
CKAP5-5555 Target:5'-TATGGACCAGACTGGGAGCAAGTCTGA-3'   (SEQ ID NO: 1523)

5'-GACCAGACUGGGAGCAAGUCUGAta-3'      (SEQ ID NO: 372)
                 3'-ACCUGGUCUGACCCUCGUUCAGACUAU-5'    (SEQ ID NO: 948)
CKAP5-5557 Target:5'-TGGACCAGACTGGGAGCAAGTCTGATA-3'   (SEQ ID NO: 1524)
```

TABLE 2-continued

Selected Human Anti-CKAP5 DsiRNA Agents (Asymmetrics)

```
                5'-CCAGACUGGGAGCAAGUCUGAUAag-3'       (SEQ ID NO: 373)
                3'-CUGGUCUGACCCUCGUUCAGACUAUUC-5'     (SEQ ID NO: 949)
CKAP5-5559 Target:5'-GACCAGACTGGGAGCAAGTCTGATAAG-3'   (SEQ ID NO: 1525)

5'-AGACUGGGAGCAAGUCUGAUAAGga-3'       (SEQ ID NO: 374)
                3'-GGUCUGACCCUCGUUCAGACUAUUCCU-5'     (SEQ ID NO: 950)
CKAP5-5561 Target:5'-CCAGACTGGGAGCAAGTCTGATAAGGA-3'   (SEQ ID NO: 1526)

5'-ACUGGGAGCAAGUCUGAUAAGGAaa-3'       (SEQ ID NO: 375)
                3'-UCUGACCCUCGUUCAGACUAUUCCUUU-5'     (SEQ ID NO: 951)
CKAP5-5563 Target:5'-AGACTGGGAGCAAGTCTGATAAGGAAA-3'   (SEQ ID NO: 1527)

5'-UGGGAGCAAGUCUGAUAAGGAAACa-3'       (SEQ ID NO: 376)
                3'-UGACCCUCGUUCAGACUAUUCCUUUGU-5'     (SEQ ID NO: 952)
CKAP5-5565 Target:5'-ACTGGGAGCAAGTCTGATAAGGAAACA-3'   (SEQ ID NO: 1528)

5'-GGAGCAAGUCUGAUAAGGAAACAga-3'       (SEQ ID NO: 377)
                3'-ACCCUCGUUCAGACUAUUCCUUUGUCU-5'     (SEQ ID NO: 953)
CKAP5-5567 Target:5'-TGGGAGCAAGTCTGATAAGGAAACAGA-3'   (SEQ ID NO: 1529)

5'-AGCAAGUCUGAUAAGGAAACAGAaa-3'       (SEQ ID NO: 378)
                3'-CCUCGUUCAGACUAUUCCUUUGUCUUU-5'     (SEQ ID NO: 954)
CKAP5-5569 Target:5'-GGAGCAAGTCTGATAAGGAAACAGAAA-3'   (SEQ ID NO: 1530)

5'-CAAGUCUGAUAAGGAAACAGAAAag-3'       (SEQ ID NO: 379)
                3'-UCGUUCAGACUAUUCCUUUGUCUUUUC-5'     (SEQ ID NO: 955)
CKAP5-5571 Target:5'-AGCAAGTCTGATAAGGAAACAGAAAAG-3'   (SEQ ID NO: 1531)

5'-AGUCUGAUAAGGAAACAGAAAAGgg-3'       (SEQ ID NO: 380)
                3'-GUUCAGACUAUUCCUUUGUCUUUUCCC-5'     (SEQ ID NO: 956)
CKAP5-5573 Target:5'-CAAGTCTGATAAGGAAACAGAAAAGGG-3'   (SEQ ID NO: 1532)

5'-UCUGAUAAGGAAACAGAAAAGGGag-3'       (SEQ ID NO: 381)
                3'-UCAGACUAUUCCUUUGUCUUUUCCCUC-5'     (SEQ ID NO: 957)
CKAP5-5575 Target:5'-AGTCTGATAAGGAAACAGAAAAGGGAG-3'   (SEQ ID NO: 1533)

5'-UGAUAAGGAAACAGAAAAGGGAGca-3'       (SEQ ID NO: 382)
                3'-AGACUAUUCCUUUGUCUUUUCCCUCGU-5'     (SEQ ID NO: 958)
CKAP5-5577 Target:5'-TCTGATAAGGAAACAGAAAAGGGAGCA-3'   (SEQ ID NO: 1534)

5'-AUAAGGAAACAGAAAAGGGAGCAtc-3'       (SEQ ID NO: 383)
                3'-ACUAUUCCUUUGUCUUUUCCCUCGUAG-5'     (SEQ ID NO: 959)
CKAP5-5579 Target:5'-TGATAAGGAAACAGAAAAGGGAGCATC-3'   (SEQ ID NO: 1535)

5'-AAGGAAACAGAAAAGGGAGCAUCtc-3'       (SEQ ID NO: 384)
                3'-UAUUCCUUUGUCUUUUCCCUCGUAGAG-5'     (SEQ ID NO: 960)
CKAP5-5581 Target:5'-ATAAGGAAACAGAAAAGGGAGCATCTC-3'   (SEQ ID NO: 1536)

5'-UCUCGAAUAGAUGAAAAAUCAUCaa-3'       (SEQ ID NO: 385)
                3'-GUAGAGCUUAUCUACUUUUUAGUAGUU-5'     (SEQ ID NO: 961)
CKAP5-5602 Target:5'-CATCTCGAATAGATGAAAAATCATCAA-3'   (SEQ ID NO: 1537)

5'-UCGAAUAGAUGAAAAAUCAUCAAag-3'       (SEQ ID NO: 386)
                3'-AGAGCUUAUCUACUUUUUAGUAGUUUC-5'     (SEQ ID NO: 962)
CKAP5-5604 Target:5'-TCTCGAATAGATGAAAAATCATCAAAG-3'   (SEQ ID NO: 1538)

5'-GAAUAGAUGAAAAAUCAUCAAAGgc-3'       (SEQ ID NO: 387)
                3'-AGCUUAUCUACUUUUUAGUAGUUUCCG-5'     (SEQ ID NO: 963)
CKAP5-5606 Target:5'-TCGAATAGATGAAAAATCATCAAAGGC-3'   (SEQ ID NO: 1539)

5'-AUAGAUGAAAAAUCAUCAAAGGCca-3'       (SEQ ID NO: 388)
                3'-CUUAUCUACUUUUUAGUAGUUUCCGGU-5'     (SEQ ID NO: 964)
CKAP5-5608 Target:5'-GAATAGATGAAAAATCATCAAAGGCCA-3'   (SEQ ID NO: 1540)

5'-AGAUGAAAAAUCAUCAAAGGCCAaa-3'       (SEQ ID NO: 389)
                3'-UAUCUACUUUUUAGUAGUUUCCGGUUU-5'     (SEQ ID NO: 965)
CKAP5-5610 Target:5'-ATAGATGAAAAATCATCAAAGGCCAAA-3'   (SEQ ID NO: 1541)

5'-AUGAAAAAUCAUCAAAGGCCAAAgt-3'       (SEQ ID NO: 390)
                3'-UCUACUUUUUAGUAGUUUCCGGUUUCA-5'     (SEQ ID NO: 966)
CKAP5-5612 Target:5'-AGATGAAAAATCATCAAAGGCCAAAGT-3'   (SEQ ID NO: 1542)

5'-GAAAAAUCAUCAAAGGCCAAAGUga-3'       (SEQ ID NO: 391)
                3'-UACUUUUUAGUAGUUUCCGGUUUCACU-5'     (SEQ ID NO: 967)
CKAP5-5614 Target:5'-ATGAAAAATCATCAAAGGCCAAAGTGA-3'   (SEQ ID NO: 1543)
```

TABLE 2-continued

Selected Human Anti-CKAP5 DsiRNA Agents (Asymmetrics)

```
                      5'-AAAAUCAUCAAAGGCCAAAGUGAat-3'      (SEQ ID NO: 392)
                      3'-CUUUUUAGUAGUUUCCGGUUUCACUUA-5'    (SEQ ID NO: 968)
CKAP5-5616 Target: 5'-GAAAAATCATCAAAGGCCAAAGTGAAT-3'       (SEQ ID NO: 1544)

5'-AAUCAUCAAAGGCCAAAGUGAAUga-3'      (SEQ ID NO: 393)
                      3'-UUUUAGUAGUUUCCGGUUUCACUUACU-5'    (SEQ ID NO: 969)
CKAP5-5618 Target: 5'-AAAATCATCAAAGGCCAAAGTGAATGA-3'       (SEQ ID NO: 1545)

5'-AUGAUUUCUUAGCUGAGAUUUUUaa-3'      (SEQ ID NO: 394)
                      3'-CUUACUAAAGAAUCGACUCUAAAAAUU-5'    (SEQ ID NO: 970)
CKAP5-5639 Target: 5'-GAATGATTTCTTAGCTGAGATTTTTAA-3'       (SEQ ID NO: 1546)

5'-GAUUUCUUAGCUGAGAUUUUUAAga-3'      (SEQ ID NO: 395)
                      3'-UACUAAAGAAUCGACUCUAAAAAUUCU-5'    (SEQ ID NO: 971)
CKAP5-5641 Target: 5'-ATGATTTCTTAGCTGAGATTTTTAAGA-3'       (SEQ ID NO: 1547)

5'-UUUCUUAGCUGAGAUUUUUAAGAag-3'      (SEQ ID NO: 396)
                      3'-CUAAAGAAUCGACUCUAAAAAUUCUUC-5'    (SEQ ID NO: 972)
CKAP5-5643 Target: 5'-GATTTCTTAGCTGAGATTTTTAAGAAG-3'       (SEQ ID NO: 1548)

5'-UCUUAGCUGAGAUUUUUAAGAAGat-3'      (SEQ ID NO: 397)
                      3'-AAAGAAUCGACUCUAAAAAUUCUUCUA-5'    (SEQ ID NO: 973)
CKAP5-5645 Target: 5'-TTTCTTAGCTGAGATTTTTAAGAAGAT-3'       (SEQ ID NO: 1549)

5'-UUAGCUGAGAUUUUUAAGAAGAUtg-3'      (SEQ ID NO: 398)
                      3'-AGAAUCGACUCUAAAAAUUCUUCUAAC-5'    (SEQ ID NO: 974)
CKAP5-5647 Target: 5'-TCTTAGCTGAGATTTTTAAGAAGATTG-3'       (SEQ ID NO: 1550)

5'-AGCUGAGAUUUUUAAGAAGAUUGgc-3'      (SEQ ID NO: 399)
                      3'-AAUCGACUCUAAAAAUUCUUCUAACCG-5'    (SEQ ID NO: 975)
CKAP5-5649 Target: 5'-TTAGCTGAGATTTTTAAGAAGATTGGC-3'       (SEQ ID NO: 1551)

5'-CUGAGAUUUUUAAGAAGAUUGGCtc-3'      (SEQ ID NO: 400)
                      3'-UCGACUCUAAAAAUUCUUCUAACCGAG-5'    (SEQ ID NO: 976)
CKAP5-5651 Target: 5'-AGCTGAGATTTTTAAGAAGATTGGCTC-3'       (SEQ ID NO: 1552)

5'-GAGAUUUUUAAGAAGAUUGGCUCta-3'      (SEQ ID NO: 401)
                      3'-GACUCUAAAAAUUCUUCUAACCGAGAU-5'    (SEQ ID NO: 977)
CKAP5-5653 Target: 5'-CTGAGATTTTTAAGAAGATTGGCTCTA-3'       (SEQ ID NO: 1553)

5'-GAUUUUUAAGAAGAUUGGCUCUAaa-3'      (SEQ ID NO: 402)
                      3'-CUCUAAAAAUUCUUCUAACCGAGAUUU-5'    (SEQ ID NO: 978)
CKAP5-5655 Target: 5'-GAGATTTTTAAGAAGATTGGCTCTAAA-3'       (SEQ ID NO: 1554)

5'-UUUUUAAGAAGAUUGGCUCUAAAga-3'      (SEQ ID NO: 403)
                      3'-CUAAAAAUUCUUCUAACCGAGAUUUCU-5'    (SEQ ID NO: 979)
CKAP5-5657 Target: 5'-GATTTTTAAGAAGATTGGCTCTAAAGA-3'       (SEQ ID NO: 1555)

5'-UAGCAGAGUUAUAUGAAUAUAAGaa-3'      (SEQ ID NO: 404)
                      3'-UGAUCGUCUCAAUAUACUUAUAUUCUU-5'    (SEQ ID NO: 980)
CKAP5-5699 Target: 5'-ACTAGCAGAGTTATATGAATATAAGAA-3'       (SEQ ID NO: 1556)

5'-GCAGAGUUAUAUGAAUAUAAGAAga-3'      (SEQ ID NO: 405)
                      3'-AUCGUCUCAAUAUACUUAUAUUCUUCU-5'    (SEQ ID NO: 981)
CKAP5-5701 Target: 5'-TAGCAGAGTTATATGAATATAAGAAGA-3'       (SEQ ID NO: 1557)

5'-AGAGUUAUAUGAAUAUAAGAAGAaa-3'      (SEQ ID NO: 406)
                      3'-CGUCUCAAUAUACUUAUAUUCUUCUUU-5'    (SEQ ID NO: 982)
CKAP5-5703 Target: 5'-GCAGAGTTATATGAATATAAGAAGAAA-3'       (SEQ ID NO: 1558)

5'-AGUUAUAUGAAUAUAAGAAGAAAta-3'      (SEQ ID NO: 407)
                      3'-UCUCAAUAUACUUAUAUUCUUCUUUAU-5'    (SEQ ID NO: 983)
CKAP5-5705 Target: 5'-AGAGTTATATGAATATAAGAAGAAATA-3'       (SEQ ID NO: 1559)

5'-UUAUAUGAAUAUAAGAAGAAAUAct-3'      (SEQ ID NO: 408)
                      3'-UCAAUAUACUUAUAUUCUUCUUUAUGA-5'    (SEQ ID NO: 984)
CKAP5-5707 Target: 5'-AGTTATATGAATATAAGAAGAAATACT-3'       (SEQ ID NO: 1560)

5'-AUAUGAAUAUAAGAAGAAAUACUca-3'      (SEQ ID NO: 409)
                      3'-AAUAUACUUAUAUUCUUCUUUAUGAGU-5'    (SEQ ID NO: 985)
CKAP5-5709 Target: 5'-TTATATGAATATAAGAAGAAATACTCA-3'       (SEQ ID NO: 1561)

5'-AUGAAUAUAAGAAGAAAUACUCAga-3'      (SEQ ID NO: 410)
                      3'-UAUACUUAUAUUCUUCUUUAUGAGUCU-5'    (SEQ ID NO: 986)
CKAP5-5711 Target: 5'-ATATGAATATAAGAAGAAATACTCAGA-3'       (SEQ ID NO: 1562)
```

TABLE 2-continued

Selected Human Anti-CKAP5 DsiRNA Agents (Asymmetrics)

```
                5'-UGACAUUGAACCAUUUCUGAAAAat-3'        (SEQ ID NO: 411)
                3'-CGACUGUAACUUGGUAAAGACUUUUUA-5'      (SEQ ID NO: 987)
CKAP5-5739 Target:5'-GCTGACATTGAACCATTTCTGAAAAAT-3'    (SEQ ID NO: 1563)

5'-ACAUUGAACCAUUUCUGAAAAAUtc-3'        (SEQ ID NO: 412)
                3'-ACUGUAACUUGGUAAAGACUUUUUAAG-5'      (SEQ ID NO: 988)
CKAP5-5741 Target:5'-TGACATTGAACCATTTCTGAAAAATTC-3'    (SEQ ID NO: 1564)

5'-AUUGAACCAUUUCUGAAAAAUUCct-3'        (SEQ ID NO: 413)
                3'-UGUAACUUGGUAAAGACUUUUUAAGGA-5'      (SEQ ID NO: 989)
CKAP5-5743 Target:5'-ACATTGAACCATTTCTGAAAAATTCCT-3'    (SEQ ID NO: 1565)

5'-UGAACCAUUUCUGAAAAAUUCCUca-3'        (SEQ ID NO: 414)
                3'-UAACUUGGUAAAGACUUUUUAAGGAGU-5'      (SEQ ID NO: 990)
CKAP5-5745 Target:5'-ATTGAACCATTTCTGAAAAATTCCTCA-3'    (SEQ ID NO: 1566)

5'-AACCAUUUCUGAAAAAUUCCUCAca-3'        (SEQ ID NO: 415)
                3'-ACUUGGUAAAGACUUUUUAAGGAGUGU-5'      (SEQ ID NO: 991)
CKAP5-5747 Target:5'-TGAACCATTTCTGAAAAATTCCTCACA-3'    (SEQ ID NO: 1567)

5'-CCAUUUCUGAAAAAUUCCUCACAgt-3'        (SEQ ID NO: 416)
                3'-UUGGUAAAGACUUUUUAAGGAGUGUCA-5'      (SEQ ID NO: 992)
CKAP5-5749 Target:5'-AACCATTTCTGAAAAATTCCTCACAGT-3'    (SEQ ID NO: 1568)

5'-AGAGGCCUUCGGGUGAUUGAGAUgg-3'        (SEQ ID NO: 417)
                3'-UUUCUCCGGAAGCCCACUAACUCUACC-5'      (SEQ ID NO: 993)
CKAP5-5794 Target:5'-AAAGAGGCCTTCGGGTGATTGAGATGG-3'    (SEQ ID NO: 1569)

5'-AGGCCUUCGGGUGAUUGAGAUGGag-3'        (SEQ ID NO: 418)
                3'-UCUCCGGAAGCCCACUAACUCUACCUC-5'      (SEQ ID NO: 994)
CKAP5-5796 Target:5'-AGAGGCCTTCGGGTGATTGAGATGGAG-3'    (SEQ ID NO: 1570)

5'-GCCUUCGGGUGAUUGAGAUGGAGag-3'        (SEQ ID NO: 419)
                3'-UCCGGAAGCCCACUAACUCUACCUCUC-5'      (SEQ ID NO: 995)
CKAP5-5798 Target:5'-AGGCCTTCGGGTGATTGAGATGGAGAG-3'    (SEQ ID NO: 1571)

5'-CUUCGGGUGAUUGAGAUGGAGAGgg-3'        (SEQ ID NO: 420)
                3'-CGGAAGCCCACUAACUCUACCUCUCCC-5'      (SEQ ID NO: 996)
CKAP5-5800 Target:5'-GCCTTCGGGTGATTGAGATGGAGAGGG-3'    (SEQ ID NO: 1572)

5'-UCGGGUGAUUGAGAUGGAGAGGGag-3'        (SEQ ID NO: 421)
                3'-GAAGCCCACUAACUCUACCUCUCCCUC-5'      (SEQ ID NO: 997)
CKAP5-5802 Target:5'-CTTCGGGTGATTGAGATGGAGAGGGAG-3'    (SEQ ID NO: 1573)

5'-GGGUGAUUGAGAUGGAGAGGGAGgg-3'        (SEQ ID NO: 422)
                3'-AGCCCACUAACUCUACCUCUCCCUCCC-5'      (SEQ ID NO: 998)
CKAP5-5804 Target:5'-TCGGGTGATTGAGATGGAGAGGGAGGG-3'    (SEQ ID NO: 1574)

5'-CCAUCUGUCUACUUGGAAAGGCUaa-3'        (SEQ ID NO: 423)
                3'-CCGGUAGACAGAUGAACCUUUCCGAUU-5'      (SEQ ID NO: 999)
CKAP5-5944 Target:5'-GGCCATCTGTCTACTTGGAAAGGCTAA-3'    (SEQ ID NO: 1575)

5'-AUCUGUCUACUUGGAAAGGCUAAag-3'        (SEQ ID NO: 424)
                3'-GGUAGACAGAUGAACCUUUCCGAUUUC-5'      (SEQ ID NO: 1000)
CKAP5-5946 Target:5'-CCATCTGTCTACTTGGAAAGGCTAAAG-3'    (SEQ ID NO: 1576)

5'-CUGUCUACUUGGAAAGGCUAAAGat-3'        (SEQ ID NO: 425)
                3'-UAGACAGAUGAACCUUUCCGAUUUCUA-5'      (SEQ ID NO: 1001)
CKAP5-5948 Target:5'-ATCTGTCTACTTGGAAAGGCTAAAGAT-3'    (SEQ ID NO: 1577)

5'-GUCUACUUGGAAAGGCUAAAGAUcc-3'        (SEQ ID NO: 426)
                3'-GACAGAUGAACCUUUCCGAUUUCUAGG-5'      (SEQ ID NO: 1002)
CKAP5-5950 Target:5'-CTGTCTACTTGGAAAGGCTAAAGATCC-3'    (SEQ ID NO: 1578)

5'-UGACCUCUUUGCUCUCCAAACCAgc-3'        (SEQ ID NO: 427)
                3'-AAACUGGAGAAACGAGAGGUUUGGUCG-5'      (SEQ ID NO: 1003)
CKAP5-6026 Target:5'-TTTGACCTCTTTGCTCTCCAAACCAGC-3'    (SEQ ID NO: 1579)

5'-ACCUCUUUGCUCUCCAAACCAGCag-3'        (SEQ ID NO: 428)
                3'-ACUGGAGAAACGAGAGGUUUGGUCGUC-5'      (SEQ ID NO: 1004)
CKAP5-6028 Target:5'-TGACCTCTTTGCTCTCCAAACCAGCAG-3'    (SEQ ID NO: 1580)

5'-CUCUUUGCUCUCCAAACCAGCAGtt-3'        (SEQ ID NO: 429)
                3'-UGGAGAAACGAGAGGUUUGGUCGUCAA-5'      (SEQ ID NO: 1005)
CKAP5-6030 Target:5'-ACCTCTTTGCTCTCCAAACCAGCAGTT-3'    (SEQ ID NO: 1581)
```

TABLE 2-continued

Selected Human Anti-CKAP5 DsiRNA Agents (Asymmetrics)

```
                5'-CUUUGCUCUCCAAACCAGCAGUUcc-3'      (SEQ ID NO: 430)
                3'-GAGAAACGAGAGGUUUGGUCGUCAAGG-5'    (SEQ ID NO: 1006)
CKAP5-6032 Target:5'-CTCTTTGCTCTCCAAACCAGCAGTTCC-3'  (SEQ ID NO: 1582)

5'-UGACCUCCUCCUCCUCCACAGCUaa-3'      (SEQ ID NO: 431)
                3'-ACACUGGAGGAGGAGGAGGUGUCGAUU-5'    (SEQ ID NO: 1007)
CKAP5-6173 Target:5'-TGTGACCTCCTCCTCCTCCACAGCTAA-3'  (SEQ ID NO: 1583)

5'-AGACUGGAGAGAAUAAAGAGCAGtc-3'      (SEQ ID NO: 432)
                3'-UUUCUGACCUCUCUUAUUUCUCGUCAG-5'    (SEQ ID NO: 1008)
CKAP5-6217 Target:5'-AAAGACTGGAGAGAATAAAGAGCAGTC-3'  (SEQ ID NO: 1584)

5'-ACUGGAGAGAAUAAAGAGCAGUCgc-3'      (SEQ ID NO: 433)
                3'-UCUGACCUCUCUUAUUUCUCGUCAGCG-5'    (SEQ ID NO: 1009)
CKAP5-6219 Target:5'-AGACTGGAGAGAATAAAGAGCAGTCGC-3'  (SEQ ID NO: 1585)

5'-UGGAGAGAAUAAAGAGCAGUCGCaa-3'      (SEQ ID NO: 434)
                3'-UGACCUCUCUUAUUUCUCGUCAGCGUU-5'    (SEQ ID NO: 1010)
CKAP5-6221 Target:5'-ACTGGAGAGAATAAAGAGCAGTCGCAA-3'  (SEQ ID NO: 1586)

5'-GAGAGAAUAAAGAGCAGUCGCAAat-3'      (SEQ ID NO: 435)
                3'-ACCUCUCUUAUUUCUCGUCAGCGUUUA-5'    (SEQ ID NO: 1011)
CKAP5-6223 Target:5'-TGGAGAGAATAAAGAGCAGTCGCAAAT-3'  (SEQ ID NO: 1587)

5'-GAGAAUAAAGAGCAGUCGCAAAUga-3'      (SEQ ID NO: 436)
                3'-CUCUCUUAUUUCUCGUCAGCGUUUACU-5'    (SEQ ID NO: 1012)
CKAP5-6225 Target:5'-GAGAGAATAAAGAGCAGTCGCAAATGA-3'  (SEQ ID NO: 1588)

5'-GAAUAAAGAGCAGUCGCAAAUGAag-3'      (SEQ ID NO: 437)
                3'-CUCUUAUUUCUCGUCAGCGUUUACUUC-5'    (SEQ ID NO: 1013)
CKAP5-6227 Target:5'-GAGAATAAAGAGCAGTCGCAAATGAAG-3'  (SEQ ID NO: 1589)

5'-AUAAAGAGCAGUCGCAAAUGAAGct-3'      (SEQ ID NO: 438)
                3'-CUUAUUUCUCGUCAGCGUUUACUUCGA-5'    (SEQ ID NO: 1014)
CKAP5-6229 Target:5'-GAATAAAGAGCAGTCGCAAATGAAGCT-3'  (SEQ ID NO: 1590)

5'-AAAGAGCAGUCGCAAAUGAAGCUgc-3'      (SEQ ID NO: 439)
                3'-UAUUUCUCGUCAGCGUUUACUUCGACG-5'    (SEQ ID NO: 1015)
CKAP5-6231 Target:5'-ATAAAGAGCAGTCGCAAATGAAGCTGC-3'  (SEQ ID NO: 1591)

5'-AGAGCAGUCGCAAAUGAAGCUGCcc-3'      (SEQ ID NO: 440)
                3'-UUUCUCGUCAGCGUUUACUUCGACGGG-5'    (SEQ ID NO: 1016)
CKAP5-6233 Target:5'-AAAGAGCAGTCGCAAATGAAGCTGCCC-3'  (SEQ ID NO: 1592)

5'-AAACUGGUUGUAUGUAUCAUGCCgt-3'      (SEQ ID NO: 441)
                3'-UGUUUGACCAACAUACAUAGUACGGCA-5'    (SEQ ID NO: 1017)
CKAP5-6342 Target:5'-ACAAACTGGTTGTATGTATCATGCCGT-3'  (SEQ ID NO: 1593)

5'-CUCAUUUGUAAAAUUGUCCUAAUct-3'      (SEQ ID NO: 442)
                3'-ACGAGUAAACAUUUUAACAGGAUUAGA-5'    (SEQ ID NO: 1018)
CKAP5-6544 Target:5'-TGCTCATTTGTAAAATTGTCCTAATCT-3'  (SEQ ID NO: 1594)

5'-CAUUUGUAAAAUUGUCCUAAUCUtt-3'      (SEQ ID NO: 443)
                3'-GAGUAAACAUUUUAACAGGAUUAGAAA-5'    (SEQ ID NO: 1019)
CKAP5-6546 Target:5'-CTCATTTGTAAAATTGTCCTAATCTTT-3'  (SEQ ID NO: 1595)

5'-UUUGUAAAAUUGUCCUAAUCUUUcc-3'      (SEQ ID NO: 444)
                3'-GUAAACAUUUUAACAGGAUUAGAAAGG-5'    (SEQ ID NO: 1020)
CKAP5-6548 Target:5'-CATTTGTAAAATTGTCCTAATCTTTCC-3'  (SEQ ID NO: 1596)

5'-ACUGUAUUCUGUAUGAAUGCAUGgc-3'      (SEQ ID NO: 445)
                3'-AGUGACAUAAGACAUACUUACGUACCG-5'    (SEQ ID NO: 1021)
CKAP5-6656 Target:5'-TCACTGTATTCTGTATGAATGCATGGC-3'  (SEQ ID NO: 1597)

5'-UGUAUUCUGUAUGAAUGCAUGGCat-3'      (SEQ ID NO: 446)
                3'-UGACAUAAGACAUACUUACGUACCGUA-5'    (SEQ ID NO: 1022)
CKAP5-6658 Target:5'-ACTGTATTCTGTATGAATGCATGGCAT-3'  (SEQ ID NO: 1598)

5'-UAUUCUGUAUGAAUGCAUGGCAUga-3'      (SEQ ID NO: 447)
                3'-ACAUAAGACAUACUUACGUACCGUACU-5'    (SEQ ID NO: 1023)
CKAP5-6660 Target:5'-TGTATTCTGTATGAATGCATGGCATGA-3'  (SEQ ID NO: 1599)

5'-UUCUGUAUGAAUGCAUGGCAUGAta-3'      (SEQ ID NO: 448)
                3'-AUAAGACAUACUUACGUACCGUACUAU-5'    (SEQ ID NO: 1024)
CKAP5-6662 Target:5'-TATTCTGTATGAATGCATGGCATGATA-3'  (SEQ ID NO: 1600)
```

TABLE 2-continued

Selected Human Anti-CKAP5 DsiRNA Agents (Asymmetrics)

```
                5'-CUGUAUGAAUGCAUGGCAUGAUAca-3'      (SEQ ID NO: 449)
                3'-AAGACAUACUUACGUACCGUACUAUGU-5'    (SEQ ID NO: 1025)
CKAP5-6664 Target:5'-TTCTGTATGAATGCATGGCATGATACA-3'  (SEQ ID NO: 1601)

5'-GUAUGAAUGCAUGGCAUGAUACAac-3'      (SEQ ID NO: 450)
                3'-GACAUACUUACGUACCGUACUAUGUUG-5'    (SEQ ID NO: 1026)
CKAP5-6666 Target:5'-CTGTATGAATGCATGGCATGATACAAC-3'  (SEQ ID NO: 1602)

5'-UUUUAUAAAUAAAGUUUGCAUUAac-3'      (SEQ ID NO: 451)
                3'-AGAAAAUAUUUAUUUCAAACGUAAUUG-5'    (SEQ ID NO: 1027)
CKAP5-6704 Target:5'-TCTTTTATAAATAAAGTTTGCATTAAC-3'  (SEQ ID NO: 1603)

5'-UUAUAAAUAAAGUUUGCAUUAACta-3'      (SEQ ID NO: 452)
                3'-AAAAUAUUUAUUUCAAACGUAAUUGAU-5'    (SEQ ID NO: 1028)
CKAP5-6706 Target:5'-TTTTATAAATAAAGTTTGCATTAACTA-3'  (SEQ ID NO: 1604)

5'-AUAAAUAAAGUUUGCAUUAACUAta-3'      (SEQ ID NO: 453)
                3'-AAUAUUUAUUUCAAACGUAAUUGAUAU-5'    (SEQ ID NO: 1029)
CKAP5-6708 Target:5'-TTATAAATAAAGTTTGCATTAACTATA-3'  (SEQ ID NO: 1605)

5'-AAAUAAAGUUUGCAUUAACUAUAcc-3'      (SEQ ID NO: 454)
                3'-UAUUUAUUUCAAACGUAAUUGAUAUGG-5'    (SEQ ID NO: 1030)
CKAP5-6710 Target:5'-ATAAATAAAGTTTGCATTAACTATACC-3'  (SEQ ID NO: 1606)

5'-AUAAAGUUUGCAUUAACUAUACCtg-3'      (SEQ ID NO: 455)
                3'-UUUAUUUCAAACGUAAUUGAUAUGGAC-5'    (SEQ ID NO: 1031)
CKAP5-6712 Target:5'-AAATAAAGTTTGCATTAACTATACCTG-3'  (SEQ ID NO: 1607)

5'-AAAGUUUGCAUUAACUAUACCUGac-3'      (SEQ ID NO: 456)
                3'-UAUUUCAAACGUAAUUGAUAUGGACUG-5'    (SEQ ID NO: 1032)
CKAP5-6714 Target:5'-ATAAAGTTTGCATTAACTATACCTGAC-3'  (SEQ ID NO: 1608)

5'-CAGCUGAGGAAAUACUCUUAAUUct-3'      (SEQ ID NO: 457)
                3'-GGGUCGACUCCUUUAUGAGAAUUAAGA-5'    (SEQ ID NO: 1033)
CKAP5-106 Target: 5'-CCCAGCTGAGGAAATACTCTTAATTCT-3'   (SEQ ID NO: 1609)

5'-UUGAAACUGCCAGUUGAUCAGAAat-3'      (SEQ ID NO: 458)
                3'-CCAACUUUGACGGUCAACUAGUCUUUA-5'    (SEQ ID NO: 1034)
CKAP5-172 Target: 5'-GGTTGAAACTGCCAGTTGATCAGAAAT-3'   (SEQ ID NO: 1610)

5'-GCCAGUUGAUCAGAAAUGUGAACac-3'      (SEQ ID NO: 459)
                3'-GACGGUCAACUAGUCUUUACACUUGUG-5'    (SEQ ID NO: 1035)
CKAP5-180 Target: 5'-CTGCCAGTTGATCAGAAATGTGAACAC-3'   (SEQ ID NO: 1611)

5'-GAAAGCAAGGUUAAGUGGGUAUGaa-3'      (SEQ ID NO: 460)
                3'-ACCUUUCGUUCCAAUUCACCCAUACUU-5'    (SEQ ID NO: 1036)
CKAP5-213 Target: 5'-TGGAAAGCAAGGTTAAGTGGGTATGAA-3'   (SEQ ID NO: 1612)

5'-CAGAGUGGUCCAAAUUUUUAGGAtt-3'      (SEQ ID NO: 461)
                3'-GGGUCUCACCAGGUUUAAAAAUCCUAA-5'    (SEQ ID NO: 1037)
CKAP5-281 Target: 5'-CCCAGAGTGGTCCAAATTTTTAGGATT-3'   (SEQ ID NO: 1613)

5'-GUGGUUCAAUUGAAAGGAUUAGAag-3'      (SEQ ID NO: 462)
                3'-GUCACCAAGUUAACUUUCCUAAUCUUC-5'    (SEQ ID NO: 1038)
CKAP5-337 Target: 5'-CAGTGGTTCAATTGAAAGGATTAGAAG-3'   (SEQ ID NO: 1614)

5'-GAUUAGAAGCUGCACUUGUUUAUgt-3'      (SEQ ID NO: 463)
                3'-UCCUAAUCUUCGACGUGAACAAAUACA-5'    (SEQ ID NO: 1039)
CKAP5-353 Target: 5'-AGGATTAGAAGCTGCACTTGTTTATGT-3'   (SEQ ID NO: 1615)

5'-CUGCACUUGUUUAUGUUGAAAAUgc-3'      (SEQ ID NO: 464)
                3'-UCGACGUGAACAAAUACAACUUUUACG-5'    (SEQ ID NO: 1040)
CKAP5-362 Target: 5'-AGCTGCACTTGTTTATGTTGAAAATGC-3'   (SEQ ID NO: 1616)

5'-CAGGAAAAACCACAGGAGAAGUUgt-3'      (SEQ ID NO: 465)
                3'-UCGUCCUUUUUGGUGUCCUCUUCAACA-5'    (SEQ ID NO: 1041)
CKAP5-395 Target: 5'-AGCAGGAAAAACCACAGGAGAAGTTGT-3'   (SEQ ID NO: 1617)

5'-CAGGUGUUGUAAGUAAGGUGUUCaa-3'      (SEQ ID NO: 466)
                3'-CAGUCCAACAACAUUCAUUCCACAAGUU-5'   (SEQ ID NO: 1042)
CKAP5-422 Target: 5'-GTCAGGTGTTGTAAGTAAGGTGTTCAA-3'   (SEQ ID NO: 1618)

5'-GUUGUAAGUAAGGUGUUCAAUCAac-3'      (SEQ ID NO: 467)
                3'-CACAACAUUCAUUCCACAAGUUAGUUG-5'    (SEQ ID NO: 1043)
CKAP5-427 Target: 5'-GTGTTGTAAGTAAGGTGTTCAATCAAC-3'   (SEQ ID NO: 1619)
```

TABLE 2-continued

Selected Human Anti-CKAP5 DsiRNA Agents (Asymmetrics)

```
                5'-UCAAUCAACCUAAAGCUAAAGCCaa-3'       (SEQ ID NO: 468)
                3'-CAAGUUAGUUGGAUUUCGAUUUCGGUU-5'    (SEQ ID NO: 1044)
CKAP5-443 Target: 5'-GTTCAATCAACCTAAAGCTAAAGCCAA-3'   (SEQ ID NO: 1620)

5'-CCUGAAAGGCUUGGACAAUAAGAat-3'      (SEQ ID NO: 469)
                3'-GAGGACUUUCCGAACCUGUUAUUCUUA-5'    (SEQ ID NO: 1045)
CKAP5-537 Target: 5'-CTCCTGAAAGGCTTGGACAATAAGAAT-3'   (SEQ ID NO: 1621)

5'-AAGCCAAUUAUCAAAGUGUUGCCaa-3'      (SEQ ID NO: 470)
                3'-AAUUCGGUUAAUAGUUUCACAACGGUU-5'    (SEQ ID NO: 1046)
CKAP5-637 Target: 5'-TTAAGCCAATTATCAAAGTGTTGCCAA-3'   (SEQ ID NO: 1622)

5'-AAAGUGUUGCCAAAACUCUUUGAgt-3'      (SEQ ID NO: 471)
                3'-AGUUUCACAACGGUUUUGAGAAACUCA-5'    (SEQ ID NO: 1047)
CKAP5-649 Target: 5'-TCAAAGTGTTGCCAAAACTCTTTGAGT-3'   (SEQ ID NO: 1623)

5'-CAAAACUCUUUGAGUCUCGAGAGaa-3'      (SEQ ID NO: 472)
                3'-CGGUUUUGAGAAACUCAGAGCUCUCUU-5'    (SEQ ID NO: 1048)
CKAP5-659 Target: 5'-GCCAAAACTCTTTGAGTCTCGAGAGAA-3'   (SEQ ID NO: 1624)

5'-CUGUUCGAGAUGAAGCCAAACUAat-3'      (SEQ ID NO: 473)
                3'-CCGACAAGCUCUACUUCGGUUUGAUUA-5'    (SEQ ID NO: 1049)
CKAP5-686 Target: 5'-GGCTGTTCGAGATGAAGCCAAACTAAT-3'   (SEQ ID NO: 1625)

5'-CAUUACAAAAUAUAAACUCUGUUca-3'      (SEQ ID NO: 474)
                3'-GGGUAAUGUUUUAUAUUUGAGACAAGU-5'    (SEQ ID NO: 1050)
CKAP5-755 Target: 5'-CCCATTACAAAATATAAACTCTGTTCA-3'   (SEQ ID NO: 1626)

5'-AAAAUAUAAACUCUGUUCAGUUGaa-3'      (SEQ ID NO: 475)
                3'-UGUUUUAUAUUUGAGACAAGUCAACUU-5'    (SEQ ID NO: 1051)
CKAP5-761 Target: 5'-ACAAAATATAAACTCTGTTCAGTTGAA-3'   (SEQ ID NO: 1627)

5'-AUAAACUCUGUUCAGUUGAAAGAac-3'      (SEQ ID NO: 476)
                3'-UAUAUUUGAGACAAGUCAACUUUCUUG-5'    (SEQ ID NO: 1052)
CKAP5-766 Target: 5'-ATATAAACTCTGTTCAGTTGAAAGAAC-3'   (SEQ ID NO: 1628)

5'-CUGUUCAGUUGAAAGAACUAGAAga-3'      (SEQ ID NO: 477)
                3'-GAGACAAGUCAACUUUCUUGAUCUUCU-5'    (SEQ ID NO: 1053)
CKAP5-773 Target: 5'-CTCTGTTCAGTTGAAAGAACTAGAAGA-3'   (SEQ ID NO: 1629)

5'-GAUGAGGUGCCACAAAUAGAUGCtt-3'      (SEQ ID NO: 478)
                3'-CACUACUCCACGGUGUUUAUCUACGAA-5'    (SEQ ID NO: 1054)
CKAP5-928 Target: 5'-GTGATGAGGTGCCACAAATAGATGCTT-3'   (SEQ ID NO: 1630)

5'-AAAUAGAUGCUUAUGAGCUUUUAga-3'      (SEQ ID NO: 479)
                3'-UGUUUAUCUACGAAUACUCGAAAAUCU-5'    (SEQ ID NO: 1055)
CKAP5-941 Target: 5'-ACAAATAGATGCTTATGAGCTTTTAGA-3'   (SEQ ID NO: 1631)

5'-AUGAGCUUUUAGAAGCUGUAGAAat-3'      (SEQ ID NO: 480)
                3'-AAUACUCGAAAAUCUUCGACAUCUUUA-5'    (SEQ ID NO: 1056)
CKAP5-953 Target: 5'-TTATGAGCTTTTAGAAGCTGTAGAAAT-3'   (SEQ ID NO: 1632)

5'-CCCUGGAGUCUGUAGAAGUACUAat-3'      (SEQ ID NO: 481)
                3'-CCGGGACCUCAGACAUCUUCAUGAUUA-5'    (SEQ ID NO: 1057)
CKAP5-1046 Target:5'-GGCCCTGGAGTCTGTAGAAGTACTAAT-3'   (SEQ ID NO: 1633)

5'-GAGUCUGUAGAAGUACUAAUAAAaa-3'      (SEQ ID NO: 482)
                3'-ACCUCAGACAUCUUCAUGAUUAUUUUU-5'    (SEQ ID NO: 1058)
CKAP5-1051 Target:5'-TGGAGTCTGTAGAAGTACTAATAAAAA-3'   (SEQ ID NO: 1634)

5'-CAGAUUUAGUAAAAGCAUUAAAGaa-3'      (SEQ ID NO: 483)
                3'-ACGUCUAAAUCAUUUUCGUAAUUUCUU-5'    (SEQ ID NO: 1059)
CKAP5-1103 Target:5'-TGCAGATTTAGTAAAAGCATTAAAGAA-3'   (SEQ ID NO: 1635)

5'-AAAAGCAUUAAAGAAGGUUGUUGga-3'      (SEQ ID NO: 484)
                3'-CAUUUUCGUAAUUUCUUCCAACAACCU-5'    (SEQ ID NO: 1060)
CKAP5-1113 Target:5'-GTAAAAGCATTAAAGAAGGTTGTTGGA-3'   (SEQ ID NO: 1636)

5'-CAUUAAAGAAGGUUGUUGGAAAGga-3'      (SEQ ID NO: 485)
                3'-UCGUAAUUUCUUCCAACAACCUUUCCU-5'    (SEQ ID NO: 1061)
CKAP5-1118 Target:5'-AGCATTAAAGAAGGTTGTTGGAAAGGA-3'   (SEQ ID NO: 1637)

5'-GAAGGUUGUUGGAAAGGACACCAat-3'      (SEQ ID NO: 486)
                3'-UUCUUCCAACAACCUUUCCUGUGGUUA-5'    (SEQ ID NO: 1062)
CKAP5-1125 Target:5'-AAGAAGGTTGTTGGAAAGGACACCAAT-3'   (SEQ ID NO: 1638)
```

TABLE 2-continued

Selected Human Anti-CKAP5 DsiRNA Agents (Asymmetrics)

```
                       5'-GGAAGAAAUUUGGACAAUAUGCAgg-3'      (SEQ ID NO: 487)
                       3'-UUCCUUCUUUAAACCUGUUAUACGUCC-5'    (SEQ ID NO: 1063)
CKAP5-1205 Target:     5'-AAGGAAGAAATTTGGACAATATGCAGG-3'    (SEQ ID NO: 1639)

5'-GUGAGGAUGUUUUAGCAGUAAUGGa-3'      (SEQ ID NO: 488)
                       3'-GUCACUCCUACAAAAUCGUCAUUACCU-5'    (SEQ ID NO: 1064)
CKAP5-1343 Target:     5'-CAGTGAGGATGTTTTAGCAGTAATGGA-3'    (SEQ ID NO: 1640)

5'-GUUUUAGCAGUAAUGGAUAAUAAaa-3'      (SEQ ID NO: 489)
                       3'-UACAAAAUCGUCAUUACCUAUUAUUUU-5'    (SEQ ID NO: 1065)
CKAP5-1351 Target:     5'-ATGTTTTAGCAGTAATGGATAATAAAA-3'    (SEQ ID NO: 1641)

5'-CAAGCAGCAGACAUCUCUUUUUAtt-3'      (SEQ ID NO: 490)
                       3'-UAGUUCGUCGUCUGUAGAGAAAAAUAA-5'    (SEQ ID NO: 1066)
CKAP5-1386 Target:     5'-ATCAAGCAGCAGACATCTCTTTTTATT-3'    (SEQ ID NO: 1642)

5'-GACAUCUCUUUUUAUUGCAAGAAgt-3'      (SEQ ID NO: 491)
                       3'-GUCUGUAGAGAAAAAUAACGUUCUUCA-5'    (SEQ ID NO: 1067)
CKAP5-1395 Target:     5'-CAGACATCTCTTTTTATTGCAAGAAGT-3'    (SEQ ID NO: 1643)

5'-UCAGAGAUGCCGCAUUUGAAGCAtt-3'      (SEQ ID NO: 492)
                       3'-UCAGUCUCUACGGCGUAAACUUCGUAA-5'    (SEQ ID NO: 1068)
CKAP5-1514 Target:     5'-AGTCAGAGATGCCGCATTTGAAGCATT-3'    (SEQ ID NO: 1644)

5'-CAUUGGGUACUGCUUUGAAGGUGgt-3'      (SEQ ID NO: 493)
                       3'-UCGUAACCCAUGACGAAACUUCCACCA-5'    (SEQ ID NO: 1069)
CKAP5-1535 Target:     5'-AGCATTGGGTACTGCTTTGAAGGTGGT-3'    (SEQ ID NO: 1645)

5'-GUGGACAAACUCAAGCUUGAUAAga-3'      (SEQ ID NO: 494)
                       3'-UACACCUGUUUGAGUUCGAACUAUUCU-5'    (SEQ ID NO: 1070)
CKAP5-1594 Target:     5'-ATGTGGACAAACTCAAGCTTGATAAGA-3'    (SEQ ID NO: 1646)

5'-AAGAAUGUUCAGAAAAGGUAGAAct-3'      (SEQ ID NO: 495)
                       3'-GUUUCUUACAAGUCUUUUCCAUCUUGA-5'    (SEQ ID NO: 1071)
CKAP5-1622 Target:     5'-CAAAGAATGTTCAGAAAAGGTAGAACT-3'    (SEQ ID NO: 1647)

5'-UCAGAAAAGGUAGAACUGAUACAtg-3'      (SEQ ID NO: 496)
                       3'-CAAGUCUUUUCCAUCUUGACUAUGUAC-5'    (SEQ ID NO: 1072)
CKAP5-1630 Target:     5'-GTTCAGAAAAGGTAGAACTGATACATG-3'    (SEQ ID NO: 1648)

5'-GGUAGAACUGAUACAUGGUAAGAaa-3'      (SEQ ID NO: 497)
                       3'-UUCCAUCUUGACUAUGUACCAUUCUUU-5'    (SEQ ID NO: 1073)
CKAP5-1638 Target:     5'-AAGGTAGAACTGATACATGGTAAGAAA-3'    (SEQ ID NO: 1649)

5'-CAGGGAAUACUGGAACCAAGAACaa-3'      (SEQ ID NO: 498)
                       3'-GCGUCCCUUAUGACCUUGGUUCUUGUU-5'    (SEQ ID NO: 1074)
CKAP5-1847 Target:     5'-CGCAGGGAATACTGGAACCAAGAACAA-3'    (SEQ ID NO: 1650)

5'-CCUGAGCUCUCGAUAGAAGUAUGtg-3'      (SEQ ID NO: 499)
                       3'-UCGGACUCGAGAGCUAUCUUCAUACAC-5'    (SEQ ID NO: 1075)
CKAP5-1903 Target:     5'-AGCCTGAGCTCTCGATAGAAGTATGTG-3'    (SEQ ID NO: 1651)

5'-CGAUAGAAGUAUGUGAAGAAAAgc-3'       (SEQ ID NO: 500)
                       3'-GAGCUAUCUUCAUACACUUCUUUUUCG-5'    (SEQ ID NO: 1076)
CKAP5-1913 Target:     5'-CTCGATAGAAGTATGTGAAGAAAAAGC-3'    (SEQ ID NO: 1652)

5'-CUUGACAGCAGUAACUGGAAAGAaa-3'      (SEQ ID NO: 501)
                       3'-AAGAACUGUCGUCAUUGACCUUUCUUU-5'    (SEQ ID NO: 1077)
CKAP5-1972 Target:     5'-TTCTTGACAGCAGTAACTGGAAAGAAA-3'    (SEQ ID NO: 1653)

5'-GCUAAUGGACCGAACUGAAAUGCca-3'      (SEQ ID NO: 502)
                       3'-CUCGAUUACCUGGCUUGACUUUACGGU-5'    (SEQ ID NO: 1078)
CKAP5-2034 Target:     5'-GAGCTAATGGACCGAACTGAAATGCCA-3'    (SEQ ID NO: 1654)

5'-UUAGUGAGGAUGCUAGCCAAGAAac-3'      (SEQ ID NO: 503)
                       3'-GUAAUCACUCCUACGAUCGGUUCUUUG-5'    (SEQ ID NO: 1079)
CKAP5-2068 Target:     5'-CATTAGTGAGGATGCTAGCCAAGAAAC-3'    (SEQ ID NO: 1655)

5'-GCCAAGAAACCUGGAUGGAAAGAaa-3'      (SEQ ID NO: 504)
                       3'-AUCGGUUCUUUGGACCUACCUUUCUUU-5'    (SEQ ID NO: 1080)
CKAP5-2083 Target:     5'-TAGCCAAGAAACCTGGATGGAAAGAAA-3'    (SEQ ID NO: 1656)

5'-GAAACCUGGAUGGAAAGAAACUAat-3'      (SEQ ID NO: 505)
                       3'-UUCUUUGGACCUACCUUUCUUUGAUUA-5'    (SEQ ID NO: 1081)
CKAP5-2088 Target:     5'-AAGAAACCTGGATGGAAAGAAACTAAT-3'    (SEQ ID NO: 1657)
```

TABLE 2-continued

Selected Human Anti-CKAP5 DsiRNA Agents (Asymmetrics)

|  |  |  |
| --- | --- | --- |
| | 5'-GUGAUGCAAAUGAAGCUUCAUAUag-3' | (SEQ ID NO: 506) |
| | 3'-UCCACUACGUUUACUUCGAAGUAUAUC-5' | (SEQ ID NO: 1082) |
| CKAP5-2119 Target: | 5'-AGGTGATGCAAATGAAGCTTCATATAG-3' | (SEQ ID NO: 1658) |
| | 5'-AAACGUCAGCUCAGGUUGUAUUAga-3' | (SEQ ID NO: 507) |
| | 3'-GUUUUGCAGUCGAGUCCAACAUAAUCU-5' | (SEQ ID NO: 1083) |
| CKAP5-2177 Target: | 5'-CAAAACGTCAGCTCAGGTTGTATTAGA-3' | (SEQ ID NO: 1659) |
| | 5'-CAAAAGAAGCUAUGACAGCAAUAgc-3' | (SEQ ID NO: 508) |
| | 3'-ACGUUUUCUUCGAUACUGUCGUUAUCG-5' | (SEQ ID NO: 1084) |
| CKAP5-2246 Target: | 5'-TGCAAAAGAAGCTATGACAGCAATAGC-3' | (SEQ ID NO: 1660) |
| | 5'-CAGCAAUAGCCGAAGCCUGUAUGtt-3' | (SEQ ID NO: 509) |
| | 3'-CUGUCGUUAUCGGCUUCGGACAUAACAA-5' | (SEQ ID NO: 1085) |
| CKAP5-2261 Target: | 5'-GACAGCAATAGCCGAAGCCTGTATGTT-3' | (SEQ ID NO: 1661) |
| | 5'-GAAGCCUGUAUGUUACCAUGGACtg-3' | (SEQ ID NO: 510) |
| | 3'-GGCUUCGGACAUACAAUGGUACCUGAC-5' | (SEQ ID NO: 1086) |
| CKAP5-2272 Target: | 5'-CCGAAGCCTGTATGTTACCATGGACTG-3' | (SEQ ID NO: 1662) |
| | 5'-AAAAUCAGUCAGAAACUCUGAAUtg-3' | (SEQ ID NO: 511) |
| | 3'-GUUUUAGUCAGUCUUUGAGACUUAAC-5' | (SEQ ID NO: 1087) |
| CKAP5-2339 Target: | 5'-CAAAAATCAGTCAGAAACTCTGAATTG-3' | (SEQ ID NO: 1663) |
| | 5'-AGCUUUCAUUAGCAAUGUGAAGAca-3' | (SEQ ID NO: 512) |
| | 3'-UUUCGAAAGUAAUCGUUACACUUCUGU-5' | (SEQ ID NO: 1088) |
| CKAP5-2412 Target: | 5'-AAAGCTTTCATTAGCAATGTGAAGACA-3' | (SEQ ID NO: 1664) |
| | 5'-GAGAAGAUGCAGGGACAAAGUCCac-3' | (SEQ ID NO: 513) |
| | 3'-AACUCUUCUACGUCCCUGUUUCAGGUG-5' | (SEQ ID NO: 1089) |
| CKAP5-2578 Target: | 5'-TTGAGAAGATGCAGGGACAAAGTCCAC-3' | (SEQ ID NO: 1665) |
| | 5'-GCAAUGAUGUCGUUGAUCUUUUGcc-3' | (SEQ ID NO: 514) |
| | 3'-CUCGUUACUACAGCAACUAGAAAACGG-5' | (SEQ ID NO: 1090) |
| CKAP5-2684 Target: | 5'-GAGCAATGATGTCGTTGATCTTTTGCC-3' | (SEQ ID NO: 1666) |
| | 5'-GAAGUGGCAGGUAUUAUUAAUGAcg-3' | (SEQ ID NO: 515) |
| | 3'-UACUUCACCGUCCAUAAUAAUUACUGC-5' | (SEQ ID NO: 1091) |
| CKAP5-2797 Target: | 5'-ATGAAGTGGCAGGTATTATTAATGACG-3' | (SEQ ID NO: 1667) |
| | 5'-GCCUUGAAGGGUCGACUCAAUGAtt-3' | (SEQ ID NO: 516) |
| | 3'-GACGGAACUUCCCAGCUGAGUUACUAA-5' | (SEQ ID NO: 1092) |
| CKAP5-2860 Target: | 5'-CTGCCTTGAAGGGTCGACTCAATGATT-3' | (SEQ ID NO: 1668) |
| | 5'-GAAGGGUCGACUCAAUGAUUCAAat-3' | (SEQ ID NO: 517) |
| | 3'-AACUUCCCAGCUGAGUUACUAAGUUUA-5' | (SEQ ID NO: 1093) |
| CKAP5-2865 Target: | 5'-TTGAAGGGTCGACTCAATGATTCAAAT-3' | (SEQ ID NO: 1669) |
| | 5'-GACUCAAUGAUUCAAAUAAAAUCtt-3' | (SEQ ID NO: 518) |
| | 3'-AGCUGAGUUACUAAGUUUAUUUUAGAA-5' | (SEQ ID NO: 1094) |
| CKAP5-2873 Target: | 5'-TCGACTCAATGATTCAAATAAAATCTT-3' | (SEQ ID NO: 1670) |
| | 5'-AUGAUUCAAAUAAAAUCUUGGUAca-3' | (SEQ ID NO: 519) |
| | 3'-GUUACUAAGUUUAUUUUAGAACCAUGU-5' | (SEQ ID NO: 1095) |
| CKAP5-2879 Target: | 5'-CAATGATTCAAATAAAATCTTGGTACA-3' | (SEQ ID NO: 1671) |
| | 5'-AGCCAUGGGCCCAAAUAUUAAGCaa-3' | (SEQ ID NO: 520) |
| | 3'-CAUCGGUACCCGGGUUUAUAAUUCGUU-5' | (SEQ ID NO: 1096) |
| CKAP5-2937 Target: | 5'-GTAGCCATGGGCCCAAATATTAAGCAA-3' | (SEQ ID NO: 1672) |
| | 5'-AAAUAUUAAGCAACAUGUAAAAAat-3' | (SEQ ID NO: 521) |
| | 3'-GGUUUAUAAUUCGUUGUACAUUUUUUA-5' | (SEQ ID NO: 1097) |
| CKAP5-2949 Target: | 5'-CCAAATATTAAGCAACATGTAAAAAAT-3' | (SEQ ID NO: 1673) |
| | 5'-CCUUGGAGACAGCAAGAACAAUGtt-3' | (SEQ ID NO: 522) |
| | 3'-CAGGAACCUCUGUCGUUCUUGUUACAA-5' | (SEQ ID NO: 1098) |
| CKAP5-2997 Target: | 5'-GTCCTTGGAGACAGCAAGAACAATGTT-3' | (SEQ ID NO: 1674) |
| | 5'-GAGACAGCAAGAACAAUGUUCGAgc-3' | (SEQ ID NO: 523) |
| | 3'-ACCUCUGUCGUUCUUGUUACAAGCUCG-5' | (SEQ ID NO: 1099) |
| CKAP5-3002 Target: | 5'-TGGAGACAGCAAGAACAATGTTCGAGC-3' | (SEQ ID NO: 1675) |
| | 5'-CAUGAUGCAUUUAGGAUAUGAAAaa-3' | (SEQ ID NO: 524) |
| | 3'-AAGUACUACGUAAAUCCUAUACUUUUU-5' | (SEQ ID NO: 1100) |
| CKAP5-3285 Target: | 5'-TTCATGATGCATTTAGGATATGAAAAA-3' | (SEQ ID NO: 1676) |

TABLE 2-continued

Selected Human Anti-CKAP5 DsiRNA Agents (Asymmetrics)

```
                  5'-CUAGAGAAAGCCAAAGUUAACAUgc-3'       (SEQ ID NO: 525)
                  3'-ACGAUCUCUUUCGGUUUCAAUUGUACG-5'     (SEQ ID NO: 1101)
CKAP5-3367 Target:5'-TGCTAGAGAAAGCCAAAGTTAACATGC-3'     (SEQ ID NO: 1677)

5'-GGGAAGAAGAUGCCAAGCAAAACca-3'       (SEQ ID NO: 526)
                  3'-UUCCCUUCUUCUACGGUUCGUUUUGGU-5'     (SEQ ID NO: 1102)
CKAP5-3571 Target:5'-AAGGGAAGAAGATGCCAAGCAAAACCA-3'     (SEQ ID NO: 1678)

5'-GAAAAGAGCAAAGGAUGAAAGAUga-3'       (SEQ ID NO: 527)
                  3'-ACCUUUUCUCGUUUCCUACUUUCUACU-5'     (SEQ ID NO: 1103)
CKAP5-3650 Target:5'-TGGAAAAGAGCAAAGGATGAAAGATGA-3'     (SEQ ID NO: 1679)

5'-GAGCAAAGGAUGAAAGAUGAAAAag-3'       (SEQ ID NO: 528)
                  3'-UUCUCGUUUCCUACUUUCUACUUUUUC-5'     (SEQ ID NO: 1104)
CKAP5-3655 Target:5'-AAGAGCAAAGGATGAAAGATGAAAAAG-3'     (SEQ ID NO: 1680)

5'-GGGAUGAAUACAUUGAGCAACUAaa-3'       (SEQ ID NO: 529)
                  3'-UGCCCUACUUAUGUAACUCGUUGAUUU-5'     (SEQ ID NO: 1105)
CKAP5-3716 Target:5'-ACGGGATGAATACATTGAGCAACTAAA-3'     (SEQ ID NO: 1681)

5'-GAAUACAUUGAGCAACUAAAGACtc-3'       (SEQ ID NO: 530)
                  3'-UACUUAUGUAACUCGUUGAUUUCUGAG-5'     (SEQ ID NO: 1106)
CKAP5-3721 Target:5'-ATGAATACATTGAGCAACTAAAGACTC-3'     (SEQ ID NO: 1682)

5'-AGUGGCUUACCCUGAGGUUUUUUga-3'       (SEQ ID NO: 531)
                  3'-UUUCACCGAAUGGGACUCCAAAAAACU-5'     (SEQ ID NO: 1107)
CKAP5-3890 Target:5'-AAAGTGGCTTACCCTGAGGTTTTTTGA-3'     (SEQ ID NO: 1683)

5'-CCUGAGGUUUUUUGACACCAAUAca-3'       (SEQ ID NO: 532)
                  3'-UGGGACUCCAAAAAACUGUGGUUAUGU-5'     (SEQ ID NO: 1108)
CKAP5-3900 Target:5'-ACCCTGAGGTTTTTTGACACCAATACA-3'     (SEQ ID NO: 1684)

5'-CAAUACAAGCGUCCUGAUGAAAGca-3'       (SEQ ID NO: 533)
                  3'-UGGUUAUGUUCGCAGGACUACUUUCGU-5'     (SEQ ID NO: 1109)
CKAP5-3918 Target:5'-ACCAATACAAGCGTCCTGATGAAAGCA-3'     (SEQ ID NO: 1685)

5'-GUCCUGAUGAAAGCACUAGAAUAtt-3'       (SEQ ID NO: 534)
                  3'-CGCAGGACUACUUUCGUGAUCUUAUAA-5'     (SEQ ID NO: 1110)
CKAP5-3928 Target:5'-GCGTCCTGATGAAAGCACTAGAATATT-3'     (SEQ ID NO: 1686)

5'-AUGAAAGCACUAGAAUAUUUAAAat-3'       (SEQ ID NO: 535)
                  3'-ACUACUUUCGUGAUCUUAUAAAUUUUA-5'     (SEQ ID NO: 1111)
CKAP5-3934 Target:5'-TGATGAAAGCACTAGAATATTTAAAAT-3'     (SEQ ID NO: 1687)

5'-GAAAUCUUUCUGAAAAGGAUAUGag-3'       (SEQ ID NO: 536)
                  3'-ACCUUUAGAAAGACUUUUCCUAUACUC-5'     (SEQ ID NO: 1112)
CKAP5-4367 Target:5'-TGGAAATCTTTCTGAAAAGGATATGAG-3'     (SEQ ID NO: 1688)

5'-GAAAAGGAUAUGAGCAUGCUCGAgg-3'       (SEQ ID NO: 537)
                  3'-GACUUUUCCUAUACUCGUACGAGCUCC-5'     (SEQ ID NO: 1113)
CKAP5-4378 Target:5'-CTGAAAAGGATATGAGCATGCTCGAGG-3'     (SEQ ID NO: 1689)

5'-GCUCCAAUGCCAACAUGUUACGCaa-3'       (SEQ ID NO: 538)
                  3'-UUCGAGGUUACGGUUGUACAAUGCGUU-5'     (SEQ ID NO: 1114)
CKAP5-4487 Target:5'-AAGCTCCAATGCCAACATGTTACGCAA-3'     (SEQ ID NO: 1690)

5'-AAUGCCAACAUGUUACGCAAGGGac-3'       (SEQ ID NO: 539)
                  3'-GGUUACGGUUGUACAAUGCGUUCCUG-5'      (SEQ ID NO: 1115)
CKAP5-4492 Target:5'-CCAATGCCAACATGTTACGCAAGGGAC-3'     (SEQ ID NO: 1691)

5'-GUGAAAUGCCAGAACUUGUUCAGca-3'       (SEQ ID NO: 540)
                  3'-UACACUUUACGGUCUUGAACAAGUCGU-5'     (SEQ ID NO: 1116)
CKAP5-4649 Target:5'-ATGTGAAATGCCAGAACTTGTTCAGCA-3'     (SEQ ID NO: 1692)

5'-CAGAACUUGUUCAGCACAAACUGga-3'       (SEQ ID NO: 541)
                  3'-CGGUCUUGAACAAGUCGUGUUUGACCU-5'     (SEQ ID NO: 1117)
CKAP5-4658 Target:5'-GCCAGAACTTGTTCAGCACAAACTGGA-3'     (SEQ ID NO: 1693)

5'-ACAAACUGGAUGACAUUUUUGAGcc-3'       (SEQ ID NO: 542)
                  3'-CGUGUUUGACCUACUGUAAAAACUCGG-5'     (SEQ ID NO: 1118)
CKAP5-4673 Target:5'-GCACAAACTGGATGACATTTTTGAGCC-3'     (SEQ ID NO: 1694)

5'-GAUGACAUUUUUGAGCCAGUCCUta-3'       (SEQ ID NO: 543)
                  3'-ACCUACUGUAAAAACUCGGUCAGGAAU-5'     (SEQ ID NO: 1119)
CKAP5-4681 Target:5'-TGGATGACATTTTTGAGCCAGTCCTTA-3'     (SEQ ID NO: 1695)
```

TABLE 2-continued

Selected Human Anti-CKAP5 DsiRNA Agents (Asymmetrics)

```
                    5'-CAUUUUUGAGCCAGUCCUUAUUCct-3'       (SEQ ID NO: 544)
                    3'-CUGUAAAAACUCGGUCAGGAAUAAGGA-5'     (SEQ ID NO: 1120)
CKAP5-4686 Target:  5'-GACATTTTTGAGCCAGTCCTTATTCCT-3'     (SEQ ID NO: 1696)

5'-GAGCCAGUCCUUAUUCCUGAACCca-3'       (SEQ ID NO: 545)
                    3'-AACUCGGUCAGGAAUAAGGACUUGGGU-5'     (SEQ ID NO: 1121)
CKAP5-4693 Target:  5'-TTGAGCCAGTCCTTATTCCTGAACCCA-3'     (SEQ ID NO: 1697)

5'-CUGGAGUACUAAAAGACCUAAUGca-3'       (SEQ ID NO: 546)
                    3'-GUGACCUCAUGAUUUCUGGAUUACGU-5'      (SEQ ID NO: 1122)
CKAP5-5057 Target:  5'-CACTGGAGTACTAAAAGACCTAATGCA-3'     (SEQ ID NO: 1698)

5'-GUGAAGGUUCUGGAGAAGUCAGAcc-3'       (SEQ ID NO: 547)
                    3'-ACCACUUCCAAGACCUCUUCAGUCUGG-5'     (SEQ ID NO: 1123)
CKAP5-5167 Target:  5'-TGGTGAAGGTTCTGGAGAAGTCAGACC-3'     (SEQ ID NO: 1699)

5'-CCUGAGUGCCCUACUUGUUUUGCtc-3'       (SEQ ID NO: 548)
                    3'-UAGGACUCACGGGAUGAACAAAACGAG-5'     (SEQ ID NO: 1124)
CKAP5-5202 Target:  5'-ATCCTGAGTGCCCTACTTGTTTTGCTC-3'     (SEQ ID NO: 1700)

5'-CAGCCAGUUCUCCCAAAUUCUCAga-3'       (SEQ ID NO: 549)
                    3'-UUGUCGGUCAAGAGGGUUUAAGAGUCU-5'     (SEQ ID NO: 1125)
CKAP5-5246 Target:  5'-AACAGCCAGTTCTCCCAAATTCTCAGA-3'     (SEQ ID NO: 1701)

5'-GCUUGUUAUGAAGUGUCUCUGGAga-3'       (SEQ ID NO: 550)
                    3'-CUCGAACAAUACUUCACAGAGACCUCU-5'     (SEQ ID NO: 1126)
CKAP5-5271 Target:  5'-GAGCTTGTTATGAAGTGTCTCTGGAGA-3'     (SEQ ID NO: 1702)

5'-CGACUGUUGCCUGAUACCAUCAAta-3'       (SEQ ID NO: 551)
                    3'-AAGCUGACAACGGACUAUGGUAGUUAU-5'     (SEQ ID NO: 1127)
CKAP5-5302 Target:  5'-TTCGACTGTTGCCTGATACCATCAATA-3'     (SEQ ID NO: 1703)

5'-GUUGCCUGAUACCAUCAAUAGCAtt-3'       (SEQ ID NO: 552)
                    3'-GACAACGGACUAUGGUAGUUAUCGUAA-5'     (SEQ ID NO: 1128)
CKAP5-5307 Target:  5'-CTGTTGCCTGATACCATCAATAGCATT-3'     (SEQ ID NO: 1704)

5'-CUGAUACCAUCAAUAGCAUUAACct-3'       (SEQ ID NO: 553)
                    3'-CGGACUAUGGUAGUUAUCGUAAUUGGA-5'     (SEQ ID NO: 1129)
CKAP5-5312 Target:  5'-GCCTGATACCATCAATAGCATTAACCT-3'     (SEQ ID NO: 1705)

5'-AUCAAUAGCAUUAACCUAGACAGaa-3'       (SEQ ID NO: 554)
                    3'-GGUAGUUAUCGUAAUUGGAUCUGUCUU-5'     (SEQ ID NO: 1130)
CKAP5-5320 Target:  5'-CCATCAATAGCATTAACCTAGACAGAA-3'     (SEQ ID NO: 1706)

5'-UAGCAUUAACCUAGACAGAAUUCtt-3'       (SEQ ID NO: 555)
                    3'-UUAUCGUAAUUGGAUCUGUCUUAAGAA-5'     (SEQ ID NO: 1131)
CKAP5-5325 Target:  5'-AATAGCATTAACCTAGACAGAATTCTT-3'     (SEQ ID NO: 1707)

5'-GAAUUCUUCUGGAUAUCCACAUUtt-3'       (SEQ ID NO: 556)
                    3'-GUCUUAAGAAGACCUAUAGGUGUAAAA-5'     (SEQ ID NO: 1132)
CKAP5-5342 Target:  5'-CAGAATTCTTCTGGATATCCACATTTT-3'     (SEQ ID NO: 1708)

5'-CUGGAUAUCCACAUUUUCAUGAAgg-3'       (SEQ ID NO: 557)
                    3'-AAGACCUAUAGGUGUAAAAGUACUUCC-5'     (SEQ ID NO: 1133)
CKAP5-5350 Target:  5'-TTCTGGATATCCACATTTTCATGAAGG-3'     (SEQ ID NO: 1709)

5'-AAAGAGAAACUGAAGCAAUGCAAaa-3'       (SEQ ID NO: 558)
                    3'-GGUUUCUCUUUGACUUCGUUACGUUUU-5'     (SEQ ID NO: 1134)
CKAP5-5383 Target:  5'-CCAAAGAGAAACTGAAGCAATGCAAAA-3'     (SEQ ID NO: 1710)

5'-GAAACUGAAGCAAUGCAAAAGUGaa-3'       (SEQ ID NO: 559)
                    3'-CUCUUUGACUUCGUUACGUUUUCACUU-5'     (SEQ ID NO: 1135)
CKAP5-5388 Target:  5'-GAGAAACTGAAGCAATGCAAAAGTGAA-3'     (SEQ ID NO: 1711)

5'-CGGAUGAUGAAGCACAGUAUGGAcc-3'       (SEQ ID NO: 560)
                    3'-CGGCCUACUACUUCGUGUCAUACCUGG-5'     (SEQ ID NO: 1136)
CKAP5-5536 Target:  5'-GCCGGATGATGAAGCACAGTATGGACC-3'     (SEQ ID NO: 1712)

5'-CAGAAAAGGGAGCAUCUCGAAUAga-3'       (SEQ ID NO: 561)
                    3'-UUGUCUUUUCCCUCGUAGAGCUUAUCU-5'     (SEQ ID NO: 1137)
CKAP5-5588 Target:  5'-AACAGAAAAGGGAGCATCTCGAATAGA-3'     (SEQ ID NO: 1713)

5'-AGGGAGCAUCUCGAAUAGAUGAAaa-3'       (SEQ ID NO: 562)
                    3'-UUUCCCUCGUAGAGCUUAUCUACUUUU-5'     (SEQ ID NO: 1138)
CKAP5-5594 Target:  5'-AAAGGGAGCATCTCGAATAGATGAAAA-3'     (SEQ ID NO: 1714)
```

TABLE 2-continued

Selected Human Anti-CKAP5 DsiRNA Agents (Asymmetrics)

```
                  5'-GCAUCUCGAAUAGAUGAAAAAUCat-3'      (SEQ ID NO: 563)
                  3'-CUCGUAGAGCUUAUCUACUUUUUAGUA-5'    (SEQ ID NO: 1139)
CKAP5-5599 Target:5'-GAGCATCTCGAATAGATGAAAAATCAT-3'    (SEQ ID NO: 1715)

5'-GAGGGACUAGCAGAGUUAUAUGAat-3'      (SEQ ID NO: 564)
                  3'-UUCUCCCUGAUCGUCUCAAUAUACUUA-5'    (SEQ ID NO: 1140)
CKAP5-5692 Target:5'-AAGAGGGACTAGCAGAGTTATATGAAT-3'    (SEQ ID NO: 1716)

5'-ACUCAGAUGCUGACAUUGAACCAtt-3'      (SEQ ID NO: 565)
                  3'-UAUGAGUCUACGACUGUAACUUGGUAA-5'    (SEQ ID NO: 1141)
CKAP5-5729 Target:5'-ATACTCAGATGCTGACATTGAACCATT-3'    (SEQ ID NO: 1717)

5'-CAUUCAGACCUGGAUUCUAACCAga-3'      (SEQ ID NO: 566)
                  3'-UCGUAAGUCUGGACCUAAGAUUGGUCU-5'    (SEQ ID NO: 1142)
CKAP5-6130 Target:5'-AGCATTCAGACCTGGATTCTAACCAGA-3'    (SEQ ID NO: 1718)

5'-GACCUGGAUUCUAACCAGACUCAct-3'      (SEQ ID NO: 567)
                  3'-GUCUGGACCUAAGAUUGGUCUGAGUGA-5'    (SEQ ID NO: 1143)
CKAP5-6136 Target:5'-CAGACCTGGATTCTAACCAGACTCACT-3'    (SEQ ID NO: 1719)

5'-GGAUUCUAACCAGACUCACUCUUca-3'      (SEQ ID NO: 568)
                  3'-GACCUAAGAUUGGUCUGAGUGAGAAGU-5'    (SEQ ID NO: 1144)
CKAP5-6141 Target:5'-CTGGATTCTAACCAGACTCACTCTTCA-3'    (SEQ ID NO: 1720)

5'-GCUAACAUAGACGACUUGAAAAAaa-3'      (SEQ ID NO: 569)
                  3'-GUCGAUUGUAUCUGCUGAACUUUUUUU-5'    (SEQ ID NO: 1145)
CKAP5-6193 Target:5'-CAGCTAACATAGACGACTTGAAAAAAA-3'    (SEQ ID NO: 1721)

5'-CAUAGACGACUUGAAAAAAAGACtg-3'      (SEQ ID NO: 570)
                  3'-UUGUAUCUGCUGAACUUUUUUUCUGAC-5'    (SEQ ID NO: 1146)
CKAP5-6198 Target:5'-AACATAGACGACTTGAAAAAAAGACTG-3'    (SEQ ID NO: 1722)

5'-CUAGAAGUCCUCAUAGUUUAAAAtg-3'      (SEQ ID NO: 571)
                  3'-UUGAUCUUCAGGAGUAUCAAAUUUUAC-5'    (SEQ ID NO: 1147)
CKAP5-6294 Target:5'-AACTAGAAGTCCTCATAGTTTAAAATG-3'    (SEQ ID NO: 1723)

5'-GAUGAGUUUAGUGUACAGACUUGta-3'      (SEQ ID NO: 572)
                  3'-ACCUACUCAAAUCACAUGUCUGAACAU-5'    (SEQ ID NO: 1148)
CKAP5-6459 Target:5'-TGGATGAGTTTAGTGTACAGACTTGTA-3'    (SEQ ID NO: 1724)

5'-CAGAUCCUUUUCUUUUCUUUUUAat-3'      (SEQ ID NO: 573)
                  3'-GGGUCUAGGAAAAGAAAAGAAAAAAUUA-5'   (SEQ ID NO: 1149)
CKAP5-6517 Target:5'-CCCAGATCCTTTTCTTTTCTTTTTAAT-3'    (SEQ ID NO: 1725)

5'-UGCUCAUUUGUAAAAUUGUCCUAat-3'      (SEQ ID NO: 574)
                  3'-UAACGAGUAAACAUUUUAACAGGAUUA-5'    (SEQ ID NO: 1150)
CKAP5-6542 Target:5'-ATTGCTCATTTGTAAAATTGTCCTAAT-3'    (SEQ ID NO: 1726)

5'-GAAGGGUCACUGUAUUCUGUAUGaa-3'      (SEQ ID NO: 575)
                  3'-GACUUCCCAGUGACAUAAGACAUACUU-5'    (SEQ ID NO: 1151)
CKAP5-6648 Target:5'-CTGAAGGGTCACTGTATTCTGTATGAA-3'    (SEQ ID NO: 1727)

5'-GUCACUGUAUUCUGUAUGAAUGCat-3'      (SEQ ID NO: 576)
                  3'-CCCAGUGACAUAAGACAUACUUACGUA-5'    (SEQ ID NO: 1152)
CKAP5-6653 Target:5'-GGGTCACTGTATTCTGTATGAATGCAT-3'    (SEQ ID NO: 1728)
```

TABLE 3

Selected Human Anti-CKAP5 DsiRNAs, Unmodified Duplexes (Asymmetrics)

```
                  5'-GAAGCACAAUGGGAGAUGACAGUGA-3'      (SEQ ID NO: 1729)
                  3'-ACCUUCGUGUUACCCUCUACUGUCACU-5'    (SEQ ID NO: 577)
CKAP5-143 Target: 5'-TGGAAGCACAATGGGAGATGACAGTGA-3'    (SEQ ID NO: 1153)

5'-AGCACAAUGGGAGAUGACAGUGAGU-3'      (SEQ ID NO: 1730)
                  3'-CUUCGUGUUACCCUCUACUGUCACUCA-5'    (SEQ ID NO: 578)
CKAP5-145 Target: 5'-GAAGCACAATGGGAGATGACAGTGAGT-3'    (SEQ ID NO: 1154)

5'-CACAAUGGGAGAUGACAGUGAGUGG-3'      (SEQ ID NO: 1731)
                  3'-UCGUGUUACCCUCUACUGUCACUCACC-5'    (SEQ ID NO: 579)
CKAP5-147 Target: 5'-AGCACAATGGGAGATGACAGTGAGTGG-3'    (SEQ ID NO: 1155)
```

TABLE 3-continued

Selected Human Anti-CKAP5 DsiRNAs, Unmodified Duplexes (Asymmetrics)

```
                     5'-CAAUGGGAGAUGACAGUGAGUGGUU-3'   (SEQ ID NO: 1732)
                     3'-GUGUUACCCUCUACUGUCACUCACCAA-5' (SEQ ID NO: 580)
CKAP5-149  Target:   5'-CACAATGGGAGATGACAGTGAGTGGTT-3' (SEQ ID NO: 1156)

5'-AUGGGAGAUGACAGUGAGUGGUUGA-3'   (SEQ ID NO: 1733)
                     3'-GUUACCCUCUACUGUCACUCACCAACU-5' (SEQ ID NO: 581)
CKAP5-151  Target:   5'-CAATGGGAGATGACAGTGAGTGGTTGA-3' (SEQ ID NO: 1157)

5'-GGGAGAUGACAGUGAGUGGUUGAAA-3'   (SEQ ID NO: 1734)
                     3'-UACCCUCUACUGUCACUCACCAACUUU-5' (SEQ ID NO: 582)
CKAP5-153  Target:   5'-ATGGGAGATGACAGTGAGTGGTTGAAA-3' (SEQ ID NO: 1158)

5'-GAGAUGACAGUGAGUGGUUGAAACU-3'   (SEQ ID NO: 1735)
                     3'-CCCUCUACUGUCACUCACCAACUUUGA-5' (SEQ ID NO: 583)
CKAP5-155  Target:   5'-GGGAGATGACAGTGAGTGGTTGAAACT-3' (SEQ ID NO: 1159)

5'-GAUGACAGUGAGUGGUUGAAACUGC-3'   (SEQ ID NO: 1736)
                     3'-CUCUACUGUCACUCACCAACUUUGACG-5' (SEQ ID NO: 584)
CKAP5-157  Target:   5'-GAGATGACAGTGAGTGGTTGAAACTGC-3' (SEQ ID NO: 1160)

5'-UGACAGUGAGUGGUUGAAACUGCCA-3'   (SEQ ID NO: 1737)
                     3'-CUACUGUCACUCACCAACUUUGACGGU-5' (SEQ ID NO: 585)
CKAP5-159  Target:   5'-GATGACAGTGAGTGGTTGAAACTGCCA-3' (SEQ ID NO: 1161)

5'-GAAGAUCUUCCAGAAAAUAAAGGAU-3'   (SEQ ID NO: 1738)
                     3'-GACUUCUAGAAGGUCUUUUAUUUCCUA-5' (SEQ ID NO: 586)
CKAP5-246  Target:   5'-CTGAAGATCTTCCAGAAAATAAAGGAT-3' (SEQ ID NO: 1162)

5'-AGAUCUUCCAGAAAAUAAAGGAUGA-3'   (SEQ ID NO: 1739)
                     3'-CUUCUAGAAGGUCUUUUAUUUCCUACU-5' (SEQ ID NO: 587)
CKAP5-248  Target:   5'-GAAGATCTTCCAGAAAATAAAGGATGA-3' (SEQ ID NO: 1163)

5'-AUCUUCCAGAAAAUAAAGGAUGAAA-3'   (SEQ ID NO: 1740)
                     3'-UCUAGAAGGUCUUUUAUUUCCUACUUU-5' (SEQ ID NO: 588)
CKAP5-250  Target:   5'-AGATCTTCCAGAAAATAAAGGATGAAA-3' (SEQ ID NO: 1164)

5'-CUUCCAGAAAAUAAAGGAUGAAAAG-3'   (SEQ ID NO: 1741)
                     3'-UAGAAGGUCUUUUAUUUCCUACUUUUC-5' (SEQ ID NO: 589)
CKAP5-252  Target:   5'-ATCTTCCAGAAAATAAAGGATGAAAAG-3' (SEQ ID NO: 1165)

5'-UCCAGAAAAUAAAGGAUGAAAAGAG-3'   (SEQ ID NO: 1742)
                     3'-GAAGGUCUUUUAUUUCCUACUUUUCUC-5' (SEQ ID NO: 590)
CKAP5-254  Target:   5'-CTTCCAGAAAATAAAGGATGAAAAGAG-3' (SEQ ID NO: 1166)

5'-CAGAAAAUAAAGGAUGAAAAGAGCC-3'   (SEQ ID NO: 1743)
                     3'-AGGUCUUUUAUUUCCUACUUUUCUCGG-5' (SEQ ID NO: 591)
CKAP5-256  Target:   5'-TCCAGAAAATAAAGGATGAAAAGAGCC-3' (SEQ ID NO: 1167)

5'-GAAAAUAAAGGAUGAAAAGAGCCCA-3'   (SEQ ID NO: 1744)
                     3'-GUCUUUUAUUUCCUACUUUUCUCGGGU-5' (SEQ ID NO: 592)
CKAP5-258  Target:   5'-CAGAAAATAAAGGATGAAAAGAGCCCA-3' (SEQ ID NO: 1168)

5'-AAAUAAAGGAUGAAAAGAGCCCAGA-3'   (SEQ ID NO: 1745)
                     3'-CUUUUAUUUCCUACUUUUCUCGGGUCU-5' (SEQ ID NO: 593)
CKAP5-260  Target:   5'-GAAAATAAAGGATGAAAAGAGCCCAGA-3' (SEQ ID NO: 1169)

5'-UCAAAAAAUUUGUCACUGAUUCCAA-3'   (SEQ ID NO: 1746)
                     3'-CUAGUUUUUUAAACAGUGACUAAGGUU-5' (SEQ ID NO: 594)
CKAP5-308  Target:   5'-GATCAAAAAATTTGTCACTGATTCCAA-3' (SEQ ID NO: 1170)

5'-AAAAAAUUUGUCACUGAUUCCAAUG-3'   (SEQ ID NO: 1747)
                     3'-AGUUUUUUAAACAGUGACUAAGGUUAC-5' (SEQ ID NO: 595)
CKAP5-310  Target:   5'-TCAAAAAATTTGTCACTGATTCCAATG-3' (SEQ ID NO: 1171)

5'-AAAAUUUGUCACUGAUUCCAAUGCA-3'   (SEQ ID NO: 1748)
                     3'-UUUUUUAAACAGUGACUAAGGUUACGU-5' (SEQ ID NO: 596)
CKAP5-312  Target:   5'-AAAAAATTTGTCACTGATTCCAATGCA-3' (SEQ ID NO: 1172)

5'-AAUUUGUCACUGAUUCCAAUGCAGU-3'   (SEQ ID NO: 1749)
                     3'-UUUUAAACAGUGACUAAGGUUACGUCA-5' (SEQ ID NO: 597)
CKAP5-314  Target:   5'-AAAATTTGTCACTGATTCCAATGCAGT-3' (SEQ ID NO: 1173)

5'-UUUGUCACUGAUUCCAAUGCAGUGG-3'   (SEQ ID NO: 1750)
                     3'-UUAAACAGUGACUAAGGUUACGUCACC-5' (SEQ ID NO: 598)
CKAP5-316  Target:   5'-AATTTGTCACTGATTCCAATGCAGTGG-3' (SEQ ID NO: 1174)
```

TABLE 3-continued

Selected Human Anti-CKAP5 DsiRNAs, Unmodified Duplexes (Asymmetrics)

```
                5'-UGUCACUGAUUCCAAUGCAGUGGUU-3'     (SEQ ID NO: 1751)
                3'-AAACAGUGACUAAGGUUACGUCACCAA-5'   (SEQ ID NO: 599)
CKAP5-318 Target: 5'-TTTGTCACTGATTCCAATGCAGTGGTT-3'  (SEQ ID NO: 1175)

5'-UCACUGAUUCCAAUGCAGUGGUUCA-3'     (SEQ ID NO: 1752)
                3'-ACAGUGACUAAGGUUACGUCACCAAGU-5'   (SEQ ID NO: 600)
CKAP5-320 Target: 5'-TGTCACTGATTCCAATGCAGTGGTTCA-3'  (SEQ ID NO: 1176)

5'-ACUGAUUCCAAUGCAGUGGUUCAAU-3'     (SEQ ID NO: 1753)
                3'-AGUGACUAAGGUUACGUCACCAAGUUA-5'   (SEQ ID NO: 601)
CKAP5-322 Target: 5'-TCACTGATTCCAATGCAGTGGTTCAAT-3'  (SEQ ID NO: 1177)

5'-UGAUUCCAAUGCAGUGGUUCAAUUG-3'     (SEQ ID NO: 1754)
                3'-UGACUAAGGUUACGUCACCAAGUUAAC-5'   (SEQ ID NO: 602)
CKAP5-324 Target: 5'-ACTGATTCCAATGCAGTGGTTCAATTG-3'  (SEQ ID NO: 1178)

5'-AUUCCAAUGCAGUGGUUCAUUGAA-3'      (SEQ ID NO: 1755)
                3'-ACUAAGGUUACGUCACCAAGUUAACUU-5'   (SEQ ID NO: 603)
CKAP5-326 Target: 5'-TGATTCCAATGCAGTGGTTCAATTGAA-3'  (SEQ ID NO: 1179)

5'-UCCAAUGCAGUGGUUCAAUUGAAAG-3'     (SEQ ID NO: 1756)
                3'-UAAGGUUACGUCACCAAGUUAACUUUC-5'   (SEQ ID NO: 604)
CKAP5-328 Target: 5'-ATTCCAATGCAGTGGTTCAATTGAAAG-3'  (SEQ ID NO: 1180)

5'-CAAUGCAGUGGUUCAAUUGAAAGGA-3'     (SEQ ID NO: 1757)
                3'-AGGUUACGUCACCAAGUUAACUUUCCU-5'   (SEQ ID NO: 605)
CKAP5-330 Target: 5'-TCCAATGCAGTGGTTCAATTGAAAGGA-3'  (SEQ ID NO: 1181)

5'-AUGCAGUGGUUCAAUUGAAAGGAUU-3'     (SEQ ID NO: 1758)
                3'-GUUACGUCACCAAGUUAACUUUCCUAA-5'   (SEQ ID NO: 606)
CKAP5-332 Target: 5'-CAATGCAGTGGTTCAATTGAAAGGATT-3'  (SEQ ID NO: 1182)

5'-GCAGUGGUUCAAUUGAAAGGAUUAG-3'     (SEQ ID NO: 1759)
                3'-UACGUCACCAAGUUAACUUUCCUAAUC-5'   (SEQ ID NO: 607)
CKAP5-334 Target: 5'-ATGCAGTGGTTCAATTGAAAGGATTAG-3'  (SEQ ID NO: 1183)

5'-AGUGGUUCAAUUGAAAGGAUUAGAA-3'     (SEQ ID NO: 1760)
                3'-CGUCACCAAGUUAACUUUCCUAAUCUU-5'   (SEQ ID NO: 608)
CKAP5-336 Target: 5'-GCAGTGGTTCAATTGAAAGGATTAGAA-3'  (SEQ ID NO: 1184)

5'-AAGAUCAUAGUGGCCUGUAUAGAGA-3'     (SEQ ID NO: 1761)
                3'-GGUUCUAGUAUCACCGGACAUAUCUCU-5'   (SEQ ID NO: 609)
CKAP5-565 Target: 5'-CCAAGATCATAGTGGCCTGTATAGAGA-3'  (SEQ ID NO: 1185)

5'-GAUCAUAGUGGCCUGUAUAGAGACA-3'     (SEQ ID NO: 1762)
                3'-UUCUAGUAUCACCGGACAUAUCUCUGU-5'   (SEQ ID NO: 610)
CKAP5-567 Target: 5'-AAGATCATAGTGGCCTGTATAGAGACA-3'  (SEQ ID NO: 1186)

5'-UCAUAGUGGCCUGUAUAGAGACACU-3'     (SEQ ID NO: 1763)
                3'-CUAGUAUCACCGGACAUAUCUCUGUGA-5'   (SEQ ID NO: 611)
CKAP5-569 Target: 5'-GATCATAGTGGCCTGTATAGAGACACT-3'  (SEQ ID NO: 1187)

5'-CACUGAGGAAAGCCUUAAGUGAAUU-3'     (SEQ ID NO: 1764)
                3'-CUGUGACUCCUUUCGGAAUUCACUUAA-5'   (SEQ ID NO: 612)
CKAP5-590 Target: 5'-GACACTGAGGAAAGCCTTAAGTGAATT-3'  (SEQ ID NO: 1188)

5'-CUGAGGAAAGCCUUAAGUGAAUUUG-3'     (SEQ ID NO: 1765)
                3'-GUGACUCCUUUCGGAAUUCACUUAAAC-5'   (SEQ ID NO: 613)
CKAP5-592 Target: 5'-CACTGAGGAAAGCCTTAAGTGAATTTG-3'  (SEQ ID NO: 1189)

5'-GAGGAAAGCCUUAAGUGAAUUUGGU-3'     (SEQ ID NO: 1766)
                3'-GACUCCUUUCGGAAUUCACUUAAACCA-5'   (SEQ ID NO: 614)
CKAP5-594 Target: 5'-CTGAGGAAAGCCTTAAGTGAATTTGGT-3'  (SEQ ID NO: 1190)

5'-GGAAAGCCUUAAGUGAAUUUGGUUC-3'     (SEQ ID NO: 1767)
                3'-CUCCUUUCGGAAUUCACUUAAACCAAG-5'   (SEQ ID NO: 615)
CKAP5-596 Target: 5'-GAGGAAAGCCTTAAGTGAATTTGGTTC-3'  (SEQ ID NO: 1191)

5'-AAAGCCUUAAGUGAAUUUGGUUCCA-3'     (SEQ ID NO: 1768)
                3'-CCUUUCGGAAUUCACUUAAACCAAGGU-5'   (SEQ ID NO: 616)
CKAP5-598 Target: 5'-GGAAAGCCTTAAGTGAATTTGGTTCCA-3'  (SEQ ID NO: 1192)

5'-AGCCUUAAGUGAAUUUGGUUCCAAA-3'     (SEQ ID NO: 1769)
                3'-UUUCGGAAUUCACUUAAACCAAGGUUU-5'   (SEQ ID NO: 617)
CKAP5-600 Target: 5'-AAAGCCTTAAGTGAATTTGGTTCCAAA-3'  (SEQ ID NO: 1193)
```

TABLE 3-continued

Selected Human Anti-CKAP5 DsiRNAs, Unmodified Duplexes (Asymmetrics)

```
               5'-CCUUAAGUGAAUUUGGUUCCAAAAU-3'      (SEQ ID NO: 1770)
               3'-UCGGAAUUCACUUAAACCAAGGUUUUA-5'    (SEQ ID NO: 618)
CKAP5-602 Target: 5'-AGCCTTAAGTGAATTTGGTTCCAAAAT-3' (SEQ ID NO: 1194)

5'-UUAAGUGAAUUUGGUUCCAAAAUCA-3'     (SEQ ID NO: 1771)
               3'-GGAAUUCACUUAAACCAAGGUUUUAGU-5'   (SEQ ID NO: 619)
CKAP5-604 Target: 5'-CCTTAAGTGAATTTGGTTCCAAAATCA-3' (SEQ ID NO: 1195)

5'-AAGUGAAUUUGGUUCCAAAAUCAUC-3'     (SEQ ID NO: 1772)
               3'-AAUUCACUUAAACCAAGGUUUUAGUAG-5'   (SEQ ID NO: 620)
CKAP5-606 Target: 5'-TTAAGTGAATTTGGTTCCAAAATCATC-3' (SEQ ID NO: 1196)

5'-GUGAAUUUGGUUCCAAAAUCAUCUU-3'     (SEQ ID NO: 1773)
               3'-UUCACUUAAACCAAGGUUUUAGUAGAA-5'   (SEQ ID NO: 621)
CKAP5-608 Target: 5'-AAGTGAATTTGGTTCCAAAATCATCTT-3' (SEQ ID NO: 1197)

5'-GAAUUUGGUUCCAAAAUCAUCUUGC-3'     (SEQ ID NO: 1774)
               3'-CACUUAAACCAAGGUUUUAGUAGAACG-5'   (SEQ ID NO: 622)
CKAP5-610 Target: 5'-GTGAATTTGGTTCCAAAATCATCTTGC-3' (SEQ ID NO: 1198)

5'-AUUUGGUUCCAAAAUCAUCUUGCUU-3'     (SEQ ID NO: 1775)
               3'-CUUAAACCAAGGUUUUAGUAGAACGAA-5'   (SEQ ID NO: 623)
CKAP5-612 Target: 5'-GAATTTGGTTCCAAAATCATCTTGCTT-3' (SEQ ID NO: 1199)

5'-CGUUCCCAACAAGAACUAGAAGCUA-3'     (SEQ ID NO: 1776)
               3'-AAGCAAGGGUUGUUCUUGAUCUUCGAU-5'   (SEQ ID NO: 624)
CKAP5-847 Target: 5'-TTCGTTCCCAACAAGAACTAGAAGCTA-3' (SEQ ID NO: 1200)

5'-UUCCCAACAAGAACUAGAAGCUAAA-3'     (SEQ ID NO: 1777)
               3'-GCAAGGGUUGUUCUUGAUCUUCGAUUU-5'   (SEQ ID NO: 625)
CKAP5-849 Target: 5'-CGTTCCCAACAAGAACTAGAAGCTAAA-3' (SEQ ID NO: 1201)

5'-CCCAACAAGAACUAGAAGCUAAAUU-3'     (SEQ ID NO: 1778)
               3'-AAGGGUUGUUCUUGAUCUUCGAUUUAA-5'   (SEQ ID NO: 626)
CKAP5-851 Target: 5'-TTCCCAACAAGAACTAGAAGCTAAATT-3' (SEQ ID NO: 1202)

5'-CAACAAGAACUAGAAGCUAAAUUGG-3'     (SEQ ID NO: 1779)
               3'-GGGUUGUUCUUGAUCUUCGAUUUAACC-5'   (SEQ ID NO: 627)
CKAP5-853 Target: 5'-CCCAACAAGAACTAGAAGCTAAATTGG-3' (SEQ ID NO: 1203)

5'-ACAAGAACUAGAAGCUAAAUUGGAA-3'     (SEQ ID NO: 1780)
               3'-GUUGUUCUUGAUCUUCGAUUUAACCUU-5'   (SEQ ID NO: 628)
CKAP5-855 Target: 5'-CAACAAGAACTAGAAGCTAAATTGGAA-3' (SEQ ID NO: 1204)

5'-AACAGUCUGCUGGUGGAGAUGCUGA-3'     (SEQ ID NO: 1781)
               3'-UGUUGUCAGACGACCACCUCUACGACU-5'   (SEQ ID NO: 629)
CKAP5-884 Target: 5'-ACAACAGTCTGCTGGTGGAGATGCTGA-3' (SEQ ID NO: 1205)

5'-CAGUCUGCUGGUGGAGAUGCUGAAG-3'     (SEQ ID NO: 1782)
               3'-UUGUCAGACGACCACCUCUACGACUUC-5'   (SEQ ID NO: 630)
CKAP5-886 Target: 5'-AACAGTCTGCTGGTGGAGATGCTGAAG-3' (SEQ ID NO: 1206)

5'-GUGGUGAUGAUGGUGAUGAGGUGCC-3'     (SEQ ID NO: 1783)
               3'-UCCACCACUACUACCACUACUCCACGG-5'   (SEQ ID NO: 631)
CKAP5-914 Target: 5'-AGGTGGTGATGATGGTGATGAGGTGCC-3' (SEQ ID NO: 1207)

5'-GGUGAUGAUGGUGAUGAGGUGCCAC-3'     (SEQ ID NO: 1784)
               3'-CACCACUACUACCACUACUCCACGGUG-5'   (SEQ ID NO: 632)
CKAP5-916 Target: 5'-GTGGTGATGATGGTGATGAGGTGCCAC-3' (SEQ ID NO: 1208)

5'-AUCCUUUCCAAACUUCCCAAAGACU-3'     (SEQ ID NO: 1785)
               3'-UUUAGGAAAGGUUUGAAGGGUUUCUGA-5'   (SEQ ID NO: 633)
CKAP5-976 Target: 5'-AAATCCTTTCCAAACTTCCCAAAGACT-3' (SEQ ID NO: 1209)

5'-CCUUUCCAAACUUCCCAAAGACUUU-3'     (SEQ ID NO: 1786)
               3'-UAGGAAAGGUUUGAAGGGUUUCUGAAA-5'   (SEQ ID NO: 634)
CKAP5-978 Target: 5'-ATCCTTTCCAAACTTCCCAAAGACTTT-3' (SEQ ID NO: 1210)

5'-UUCCAAACUUCCCAAAGACUUUUA-3'      (SEQ ID NO: 1787)
               3'-GGAAAGGUUUGAAGGGUUUCUGAAAAU-5'   (SEQ ID NO: 635)
CKAP5-980 Target: 5'-CCTTTCCAAACTTCCCAAAGACTTTTA-3' (SEQ ID NO: 1211)

5'-UCCAAACUUCCCAAAGACUUUUAUG-3'     (SEQ ID NO: 1788)
               3'-AAAGGUUUGAAGGGUUUCUGAAAAUAC-5'   (SEQ ID NO: 636)
CKAP5-982 Target: 5'-TTTCCAAACTTCCCAAAGACTTTTATG-3' (SEQ ID NO: 1212)
```

TABLE 3-continued

Selected Human Anti-CKAP5 DsiRNAs, Unmodified Duplexes (Asymmetrics)

```
                5'-CAAACUUCCCAAAGACUUUUAUGAC-3'      (SEQ ID NO: 1789)
                3'-AGGUUUGAAGGGUUUCUGAAAAUACUG-5'    (SEQ ID NO: 637)
CKAP5-984 Target: 5'-TCCAAACTTCCCAAAGACTTTTATGAC-3'   (SEQ ID NO: 1213)

5'-AACUUCCCAAAGACUUUUAUGACAA-3'      (SEQ ID NO: 1790)
                3'-GUUUGAAGGGUUUCUGAAAAUACUGUU-5'    (SEQ ID NO: 638)
CKAP5-986 Target: 5'-CAAACTTCCCAAAGACTTTTATGACAA-3'   (SEQ ID NO: 1214)

5'-CUUCCCAAAGACUUUUAUGACAAAA-3'      (SEQ ID NO: 1791)
                3'-UUGAAGGGUUUCUGAAAAUACUGUUUU-5'    (SEQ ID NO: 639)
CKAP5-988 Target: 5'-AACTTCCCAAAGACTTTTATGACAAAA-3'   (SEQ ID NO: 1215)

5'-UCCCAAAGACUUUUAUGACAAAAUU-3'      (SEQ ID NO: 1792)
                3'-GAAGGGUUUCUGAAAAUACUGUUUUAA-5'    (SEQ ID NO: 640)
CKAP5-990 Target: 5'-CTTCCCAAAGACTTTTATGACAAAATT-3'   (SEQ ID NO: 1216)

5'-CCAAAGACUUUUAUGACAAAAUUGA-3'      (SEQ ID NO: 1793)
                3'-AGGGUUUCUGAAAAUACUGUUUUAACU-5'    (SEQ ID NO: 641)
CKAP5-992 Target: 5'-TCCCAAAGACTTTTATGACAAAATTGA-3'   (SEQ ID NO: 1217)

5'-AAAGACUUUUAUGACAAAAUUGAGG-3'      (SEQ ID NO: 1794)
                3'-GGUUUCUGAAAAUACUGUUUUAACUCC-5'    (SEQ ID NO: 642)
CKAP5-994 Target: 5'-CCAAAGACTTTTATGACAAAATTGAGG-3'   (SEQ ID NO: 1218)

5'-AGACUUUUAUGACAAAAUUGAGGCA-3'      (SEQ ID NO: 1795)
                3'-UUUCUGAAAAUACUGUUUUAACUCCGU-5'    (SEQ ID NO: 643)
CKAP5-996 Target: 5'-AAAGACTTTTATGACAAAATTGAGGCA-3'   (SEQ ID NO: 1219)

5'-ACUUUUAUGACAAAAUUGAGGCAAA-3'      (SEQ ID NO: 1796)
                3'-UCUGAAAAUACUGUUUUAACUCCGUUU-5'    (SEQ ID NO: 644)
CKAP5-998 Target: 5'-AGACTTTTATGACAAAATTGAGGCAAA-3'   (SEQ ID NO: 1220)

5'-UUUUAUGACAAAAUUGAGGCAAAAA-3'      (SEQ ID NO: 1797)
                3'-UGAAAAUACUGUUUUAACUCCGUUUUU-5'    (SEQ ID NO: 645)
CKAP5-1000 Target:5'-ACTTTTATGACAAAATTGAGGCAAAAA-3'   (SEQ ID NO: 1221)

5'-UUAUGACAAAAUUGAGGCAAAAAAA-3'      (SEQ ID NO: 1798)
                3'-AAAAUACUGUUUUAACUCCGUUUUUUU-5'    (SEQ ID NO: 646)
CKAP5-1002 Target:5'-TTTTATGACAAAATTGAGGCAAAAAAA-3'   (SEQ ID NO: 1222)

5'-AUGACAAAAUUGAGGCAAAAAAAUG-3'      (SEQ ID NO: 1799)
                3'-AAUACUGUUUUAACUCCGUUUUUUUAC-5'    (SEQ ID NO: 647)
CKAP5-1004 Target:5'-TTATGACAAAATTGAGGCAAAAAAATG-3'   (SEQ ID NO: 1223)

5'-AAUGGCAAGAGAGAAAAGAGGCCCU-3'      (SEQ ID NO: 1800)
                3'-UUUUACCGUUCUCUCUUUUCUCCGGGA-5'    (SEQ ID NO: 648)
CKAP5-1025 Target:5'-AAAATGGCAAGAGAGAAAAGAGGCCCT-3'   (SEQ ID NO: 1224)

5'-AGGUUGUUGGAAAGGACACCAAUGU-3'      (SEQ ID NO: 1801)
                3'-CUUCCAACAACCUUUCCUGUGGUUACA-5'    (SEQ ID NO: 649)
CKAP5-1127 Target:5'-GAAGGTTGTTGGAAAGGACACCAATGT-3'   (SEQ ID NO: 1225)

5'-GUUGUUGGAAAGGACACCAAUGUCA-3'      (SEQ ID NO: 1802)
                3'-UCCAACAACCUUUCCUGUGGUUACAGU-5'    (SEQ ID NO: 650)
CKAP5-1129 Target:5'-AGGTTGTTGGAAAGGACACCAATGTCA-3'   (SEQ ID NO: 1226)

5'-UGUUGGAAAGGACACCAAUGUCAUG-3'      (SEQ ID NO: 1803)
                3'-CAACAACCUUUCCUGUGGUUACAGUAC-5'    (SEQ ID NO: 651)
CKAP5-1131 Target:5'-GTTGTTGGAAAGGACACCAATGTCATG-3'   (SEQ ID NO: 1227)

5'-UUGGAAAGGACACCAAUGUCAUGUU-3'      (SEQ ID NO: 1804)
                3'-ACAACCUUUCCUGUGGUUACAGUACAA-5'    (SEQ ID NO: 652)
CKAP5-1133 Target:5'-TGTTGGAAAGGACACCAATGTCATGTT-3'   (SEQ ID NO: 1228)

5'-GGAAAGGACACCAAUGUCAUGUUGG-3'      (SEQ ID NO: 1805)
                3'-AACCUUUCCUGUGGUUACAGUACAACC-5'    (SEQ ID NO: 653)
CKAP5-1135 Target:5'-TTGGAAAGGACACCAATGTCATGTTGG-3'   (SEQ ID NO: 1229)

5'-AAAGGACACCAAUGUCAUGUUGGUG-3'      (SEQ ID NO: 1806)
                3'-CCUUUCCUGUGGUUACAGUACAACCAC-5'    (SEQ ID NO: 654)
CKAP5-1137 Target:5'-GGAAAGGACACCAATGTCATGTTGGTG-3'   (SEQ ID NO: 1230)

5'-AGGACACCAAUGUCAUGUUGGUGGC-3'      (SEQ ID NO: 1807)
                3'-UUUCCUGUGGUUACAGUACAACCACCG-5'    (SEQ ID NO: 655)
CKAP5-1139 Target:5'-AAAGGACACCAATGTCATGTTGGTGGC-3'   (SEQ ID NO: 1231)
```

TABLE 3-continued

Selected Human Anti-CKAP5 DsiRNAs, Unmodified Duplexes (Asymmetrics)

```
                5'-GACACCAAUGUCAUGUUGGUGGCUU-3'      (SEQ ID NO: 1808)
                3'-UCCUGUGGUUACAGUACAACCACCGAA-5'    (SEQ ID NO: 656)
CKAP5-1141 Target:5'-AGGACACCAATGTCATGTTGGTGGCTT-3'  (SEQ ID NO: 1232)

5'-GCUUUGGCAGCAAAAUGUCUUACUG-3'      (SEQ ID NO: 1809)
                3'-ACCGAAACCGUCGUUUUACAGAAUGAC-5'    (SEQ ID NO: 657)
CKAP5-1162 Target:5'-TGGCTTTGGCAGCAAAATGTCTTACTG-3'  (SEQ ID NO: 1233)

5'-UUUGGCAGCAAAAUGUCUUACUGGC-3'      (SEQ ID NO: 1810)
                3'-CGAAACCGUCGUUUUACAGAAUGACCG-5'    (SEQ ID NO: 658)
CKAP5-1164 Target:5'-GCTTTGGCAGCAAAATGTCTTACTGGC-3'  (SEQ ID NO: 1234)

5'-UGGCAGCAAAAUGUCUUACUGGCCU-3'      (SEQ ID NO: 1811)
                3'-AAACCGUCGUUUUACAGAAUGACCGGA-5'    (SEQ ID NO: 659)
CKAP5-1166 Target:5'-TTTGGCAGCAAAATGTCTTACTGGCCT-3'  (SEQ ID NO: 1235)

5'-GCAGCAAAAUGUCUUACUGGCCUGG-3'      (SEQ ID NO: 1812)
                3'-ACCGUCGUUUUACAGAAUGACCGGACC-5'    (SEQ ID NO: 660)
CKAP5-1168 Target:5'-TGGCAGCAAAATGTCTTACTGGCCTGG-3'  (SEQ ID NO: 1236)

5'-AGCAAAAUGUCUUACUGGCCUGGCU-3'      (SEQ ID NO: 1813)
                3'-CGUCGUUUUACAGAAUGACCGGACCGA-5'    (SEQ ID NO: 661)
CKAP5-1170 Target:5'-GCAGCAAAATGTCTTACTGGCCTGGCT-3'  (SEQ ID NO: 1237)

5'-AGAAAUUUGGACAAUAUGCAGGACA-3'      (SEQ ID NO: 1814)
                3'-CUUCUUUAAACCUGUUAUACGUCCUGU-5'    (SEQ ID NO: 662)
CKAP5-1208 Target:5'-GAAGAAATTTGGACAATATGCAGGACA-3'  (SEQ ID NO: 1238)

5'-AAAUUUGGACAAUAUGCAGGACAUG-3'      (SEQ ID NO: 1815)
                3'-UCUUUAAACCUGUUAUACGUCCUGUAC-5'    (SEQ ID NO: 663)
CKAP5-1210 Target:5'-AGAAATTTGGACAATATGCAGGACATG-3'  (SEQ ID NO: 1239)

5'-AUUUGGACAAUAUGCAGGACAUGUU-3'      (SEQ ID NO: 1816)
                3'-UUUAAACCUGUUAUACGUCCUGUACAA-5'    (SEQ ID NO: 664)
CKAP5-1212 Target:5'-AAATTTGGACAATATGCAGGACATGTT-3'  (SEQ ID NO: 1240)

5'-UUGGACAAUAUGCAGGACAUGUUGU-3'      (SEQ ID NO: 1817)
                3'-UAAACCUGUUAUACGUCCUGUACAACA-5'    (SEQ ID NO: 665)
CKAP5-1214 Target:5'-ATTTGGACAATATGCAGGACATGTTGT-3'  (SEQ ID NO: 1241)

5'-GGACAAUAUGCAGGACAUGUUGUGC-3'      (SEQ ID NO: 1818)
                3'-AACCUGUUAUACGUCCUGUACAACACG-5'    (SEQ ID NO: 666)
CKAP5-1216 Target:5'-TTGGACAATATGCAGGACATGTTGTGC-3'  (SEQ ID NO: 1242)

5'-ACAAUAUGCAGGACAUGUUGUGCCA-3'      (SEQ ID NO: 1819)
                3'-CCUGUUAUACGUCCUGUACAACACGGU-5'    (SEQ ID NO: 667)
CKAP5-1218 Target:5'-GGACAATATGCAGGACATGTTGTGCCA-3'  (SEQ ID NO: 1243)

5'-AAUAUGCAGGACAUGUUGUGCCAAC-3'      (SEQ ID NO: 1820)
                3'-UGUUAUACGUCCUGUACAACACGGUUG-5'    (SEQ ID NO: 668)
CKAP5-1220 Target:5'-ACAATATGCAGGACATGTTGTGCCAAC-3'  (SEQ ID NO: 1244)

5'-UAUGCAGGACAUGUUGUGCCAACCA-3'      (SEQ ID NO: 1821)
                3'-UUUAUACGUCCUGUACAACACGGUUGGU-5'   (SEQ ID NO: 669)
CKAP5-1222 Target:5'-AATATGCAGGACATGTTGTGCCAACCA-3'  (SEQ ID NO: 1245)

5'-UGCAGGACAUGUUGUGCCAACCAUC-3'      (SEQ ID NO: 1822)
                3'-AUACGUCCUGUACAACACGGUUGGUAG-5'    (SEQ ID NO: 670)
CKAP5-1224 Target:5'-TATGCAGGACATGTTGTGCCAACCATC-3'  (SEQ ID NO: 1246)

5'-CAGGACAUGUUGUGCCAACCAUCUU-3'      (SEQ ID NO: 1823)
                3'-ACGUCCUGUACAACACGGUUGGUAGAA-5'    (SEQ ID NO: 671)
CKAP5-1226 Target:5'-TGCAGGACATGTTGTGCCAACCATCTT-3'  (SEQ ID NO: 1247)

5'-CUCAAGUGGUACAAGCCCUGCAGGA-3'      (SEQ ID NO: 1824)
                3'-UGGAGUUCACCAUGUUCGGGACGUCCU-5'    (SEQ ID NO: 672)
CKAP5-1274 Target:5'-ACCTCAAGTGGTACAAGCCCTGCAGGA-3'  (SEQ ID NO: 1248)

5'-CAAGUGGUACAAGCCCUGCAGGAGG-3'      (SEQ ID NO: 1825)
                3'-GAGUUCACCAUGUUCGGGACGUCCUCC-5'    (SEQ ID NO: 673)
CKAP5-1276 Target:5'-CTCAAGTGGTACAAGCCCTGCAGGAGG-3'  (SEQ ID NO: 1249)

5'-AGUGGUACAAGCCCUGCAGGAGGCA-3'      (SEQ ID NO: 1826)
                3'-GUUCACCAUGUUCGGGACGUCCUCCGU-5'    (SEQ ID NO: 674)
CKAP5-1278 Target:5'-CAAGTGGTACAAGCCCTGCAGGAGGCA-3'  (SEQ ID NO: 1250)
```

TABLE 3-continued

Selected Human Anti-CKAP5 DsiRNAs, Unmodified Duplexes (Asymmetrics)

```
                5'-UGGUACAAGCCCUGCAGGAGGCAAU-3'    (SEQ ID NO: 1827)
                3'-UCACCAUGUUCGGGACGUCCUCCGUUA-5'  (SEQ ID NO: 675)
CKAP5-1280 Target: 5'-AGTGGTACAAGCCCTGCAGGAGGCAAT-3' (SEQ ID NO: 1251)

5'-GUACAAGCCCUGCAGGAGGCAAUUG-3'    (SEQ ID NO: 1828)
                3'-ACCAUGUUCGGGACGUCCUCCGUUAAC-5'  (SEQ ID NO: 676)
CKAP5-1282 Target: 5'-TGGTACAAGCCCTGCAGGAGGCAATTG-3' (SEQ ID NO: 1252)

5'-ACAAGCCCUGCAGGAGGCAAUUGAU-3'    (SEQ ID NO: 1829)
                3'-CAUGUUCGGGACGUCCUCCGUUAACUA-5'  (SEQ ID NO: 677)
CKAP5-1284 Target: 5'-GTACAAGCCCTGCAGGAGGCAATTGAT-3' (SEQ ID NO: 1253)

5'-AAGCCCUGCAGGAGGCAAUUGAUGC-3'    (SEQ ID NO: 1830)
                3'-UGUUCGGGACGUCCUCCGUUAACUACG-5'  (SEQ ID NO: 678)
CKAP5-1286 Target: 5'-ACAAGCCCTGCAGGAGGCAATTGATGC-3' (SEQ ID NO: 1254)

5'-GCCCUGCAGGAGGCAAUUGAUGCAA-3'    (SEQ ID NO: 1831)
                3'-UUCGGGACGUCCUCCGUUAACUACGUU-5'  (SEQ ID NO: 679)
CKAP5-1288 Target: 5'-AAGCCCTGCAGGAGGCAATTGATGCAA-3' (SEQ ID NO: 1255)

5'-CCUGCAGGAGGCAAUUGAUGCAAUC-3'    (SEQ ID NO: 1832)
                3'-CGGGACGUCCUCCGUUAACUACGUUAG-5'  (SEQ ID NO: 680)
CKAP5-1290 Target: 5'-GCCCTGCAGGAGGCAATTGATGCAATC-3' (SEQ ID NO: 1256)

5'-UGCAGGAGGCAAUUGAUGCAAUCUU-3'    (SEQ ID NO: 1833)
                3'-GGACGUCCUCCGUUAACUACGUUAGAA-5'  (SEQ ID NO: 681)
CKAP5-1292 Target: 5'-CCTGCAGGAGGCAATTGATGCAATCTT-3' (SEQ ID NO: 1257)

5'-CAGGAGGCAAUUGAUGCAAUCUUCC-3'    (SEQ ID NO: 1834)
                3'-ACGUCCUCCGUUAACUACGUUAGAAGG-5'  (SEQ ID NO: 682)
CKAP5-1294 Target: 5'-TGCAGGAGGCAATTGATGCAATCTTCC-3' (SEQ ID NO: 1258)

5'-GGAGGCAAUUGAUGCAAUCUUCCUU-3'    (SEQ ID NO: 1835)
                3'-GUCCUCCGUUAACUACGUUAGAAGGAA-5'  (SEQ ID NO: 683)
CKAP5-1296 Target: 5'-CAGGAGGCAATTGATGCAATCTTCCTT-3' (SEQ ID NO: 1259)

5'-AGGCAAUUGAUGCAAUCUUCCUUAC-3'    (SEQ ID NO: 1836)
                3'-CCUCCGUUAACUACGUUAGAAGGAAUG-5'  (SEQ ID NO: 684)
CKAP5-1298 Target: 5'-GGAGGCAATTGATGCAATCTTCCTTAC-3' (SEQ ID NO: 1260)

5'-GCAAUUGAUGCAAUCUUCCUUACUA-3'    (SEQ ID NO: 1837)
                3'-UCCGUUAACUACGUUAGAAGGAAUGAU-5'  (SEQ ID NO: 685)
CKAP5-1300 Target: 5'-AGGCAATTGATGCAATCTTCCTTACTA-3' (SEQ ID NO: 1261)

5'-ACUACCACACUACAGAACAUCAGUG-3'    (SEQ ID NO: 1838)
                3'-AAUGAUGGUGUGAUGUCUUGUAGUCAC-5'  (SEQ ID NO: 686)
CKAP5-1321 Target: 5'-TTACTACCACACTACAGAACATCAGTG-3' (SEQ ID NO: 1262)

5'-UACCACACUACAGAACAUCAGUGAG-3'    (SEQ ID NO: 1839)
                3'-UGAUGGUGUGAUGUCUUGUAGUCACUC-5'  (SEQ ID NO: 687)
CKAP5-1323 Target: 5'-ACTACCACACTACAGAACATCAGTGAG-3' (SEQ ID NO: 1263)

5'-CCACACUACAGAACAUCAGUGAGGA-3'    (SEQ ID NO: 1840)
                3'-AUGGUGUGAUGUCUUGUAGUCACUCCU-5'  (SEQ ID NO: 688)
CKAP5-1325 Target: 5'-TACCACACTACAGAACATCAGTGAGGA-3' (SEQ ID NO: 1264)

5'-ACACUACAGAACAUCAGUGAGGAUG-3'    (SEQ ID NO: 1841)
                3'-GGUGUGAUGUCUUGUAGUCACUCCUAC-5'  (SEQ ID NO: 689)
CKAP5-1327 Target: 5'-CCACACTACAGAACATCAGTGAGGATG-3' (SEQ ID NO: 1265)

5'-ACUACAGAACAUCAGUGAGGAUGUU-3'    (SEQ ID NO: 1842)
                3'-UGUGAUGUCUUGUAGUCACUCCUACAA-5'  (SEQ ID NO: 690)
CKAP5-1329 Target: 5'-ACACTACAGAACATCAGTGAGGATGTT-3' (SEQ ID NO: 1266)

5'-UACAGAACAUCAGUGAGGAUGUUUU-3'    (SEQ ID NO: 1843)
                3'-UGAUGUCUUGUAGUCACUCCUACAAAA-5'  (SEQ ID NO: 691)
CKAP5-1331 Target: 5'-ACTACAGAACATCAGTGAGGATGTTTT-3' (SEQ ID NO: 1267)

5'-CAGAACAUCAGUGAGGAUGUUUUAG-3'    (SEQ ID NO: 1844)
                3'-AUGUCUUGUAGUCACUCCUACAAAAUC-5'  (SEQ ID NO: 692)
CKAP5-1333 Target: 5'-TACAGAACATCAGTGAGGATGTTTTAG-3' (SEQ ID NO: 1268)

5'-UUAGCAGUAAUGGAUAAUAAAAAUC-3'    (SEQ ID NO: 1845)
                3'-AAAAUCGUCAUUACCUAUUAUUUUUAG-5'  (SEQ ID NO: 693)
CKAP5-1354 Target: 5'-TTTTAGCAGTAATGGATAATAAAAATC-3' (SEQ ID NO: 1269)
```

TABLE 3-continued

Selected Human Anti-CKAP5 DsiRNAs, Unmodified Duplexes (Asymmetrics)

```
                5'-AGCAGUAAUGGAUAAUAAAAAUCCA-3'        (SEQ ID NO: 1846)
                3'-AAUCGUCAUUACCUAUUAUUUUUAGGU-5'      (SEQ ID NO: 694)
CKAP5-1356 Target:5'-TTAGCAGTAATGGATAATAAAAATCCA-3'    (SEQ ID NO: 1270)

5'-CAGUAAUGGAUAAUAAAAAUCCAAC-3'        (SEQ ID NO: 1847)
                3'-UCGUCAUUACCUAUUAUUUUUAGGUUG-5'      (SEQ ID NO: 695)
CKAP5-1358 Target:5'-AGCAGTAATGGATAATAAAAATCCAAC-3'    (SEQ ID NO: 1271)

5'-GUAAUGGAUAAUAAAAAUCCAACCA-3'        (SEQ ID NO: 1848)
                3'-GUCAUUACCUAUUAUUUUUAGGUUGGU-5'      (SEQ ID NO: 696)
CKAP5-1360 Target:5'-CAGTAATGGATAATAAAAATCCAACCA-3'    (SEQ ID NO: 1272)

5'-ACCAUCAAGCAGCAGACAUCUCUUU-3'        (SEQ ID NO: 1849)
                3'-GUUGGUAGUUCGUCGUCUGUAGAGAAA-5'      (SEQ ID NO: 697)
CKAP5-1381 Target:5'-CAACCATCAAGCAGCAGACATCTCTTT-3'    (SEQ ID NO: 1273)

5'-CUACUUAAGCACAUCAAUGAUUCUG-3'        (SEQ ID NO: 1850)
                3'-GUGAUGAAUUCGUGUAGUUACUAAGAC-5'      (SEQ ID NO: 698)
CKAP5-1480 Target:5'-CACTACTTAAGCACATCAATGATTCTG-3'    (SEQ ID NO: 1274)

5'-ACUUAAGCACAUCAAUGAUUCUGCU-3'        (SEQ ID NO: 1851)
                3'-GAUGAAUUCGUGUAGUUACUAAGACGA-5'      (SEQ ID NO: 699)
CKAP5-1482 Target:5'-CTACTTAAGCACATCAATGATTCTGCT-3'    (SEQ ID NO: 1275)

5'-UUAAGCACAUCAAUGAUUCUGCUCC-3'        (SEQ ID NO: 1852)
                3'-UGAAUUCGUGUAGUUACUAAGACGAGG-5'      (SEQ ID NO: 700)
CKAP5-1484 Target:5'-ACTTAAGCACATCAATGATTCTGCTCC-3'    (SEQ ID NO: 1276)

5'-AAGCACAUCAAUGAUUCUGCUCCUG-3'        (SEQ ID NO: 1853)
                3'-AAUUCGUGUAGUUACUAAGACGAGGAC-5'      (SEQ ID NO: 701)
CKAP5-1486 Target:5'-TTAAGCACATCAATGATTCTGCTCCTG-3'    (SEQ ID NO: 1277)

5'-GCACAUCAAUGAUUCUGCUCCUGAA-3'        (SEQ ID NO: 1854)
                3'-UUCGUGUAGUUACUAAGACGAGGACUU-5'      (SEQ ID NO: 702)
CKAP5-1488 Target:5'-AAGCACATCAATGATTCTGCTCCTGAA-3'    (SEQ ID NO: 1278)

5'-ACAUCAAUGAUUCUGCUCCUGAAGU-3'        (SEQ ID NO: 1855)
                3'-CGUGUAGUUACUAAGACGAGGACUUCA-5'      (SEQ ID NO: 703)
CKAP5-1490 Target:5'-GCACATCAATGATTCTGCTCCTGAAGT-3'    (SEQ ID NO: 1279)

5'-AUCAAUGAUUCUGCUCCUGAAGUCA-3'        (SEQ ID NO: 1856)
                3'-UGUAGUUACUAAGACGAGGACUUCAGU-5'      (SEQ ID NO: 704)
CKAP5-1492 Target:5'-ACATCAATGATTCTGCTCCTGAAGTCA-3'    (SEQ ID NO: 1280)

5'-CAAUGAUUCUGCUCCUGAAGUCAGA-3'        (SEQ ID NO: 1857)
                3'-UAGUUACUAAGACGAGGACUUCAGUCU-5'      (SEQ ID NO: 705)
CKAP5-1494 Target:5'-ATCAATGATTCTGCTCCTGAAGTCAGA-3'    (SEQ ID NO: 1281)

5'-AUGAUUCUGCUCCUGAAGUCAGAGA-3'        (SEQ ID NO: 1858)
                3'-GUUACUAAGACGAGGACUUCAGUCUCU-5'      (SEQ ID NO: 706)
CKAP5-1496 Target:5'-CAATGATTCTGCTCCTGAAGTCAGAGA-3'    (SEQ ID NO: 1282)

5'-GAUUCUGCUCCUGAAGUCAGAGAUG-3'        (SEQ ID NO: 1859)
                3'-UACUAAGACGAGGACUUCAGUCUCUAC-5'      (SEQ ID NO: 707)
CKAP5-1498 Target:5'-ATGATTCTGCTCCTGAAGTCAGAGATG-3'    (SEQ ID NO: 1283)

5'-UUCUGCUCCUGAAGUCAGAGAUGCC-3'        (SEQ ID NO: 1860)
                3'-CUAAGACGAGGACUUCAGUCUCUACGG-5'      (SEQ ID NO: 708)
CKAP5-1500 Target:5'-GATTCTGCTCCTGAAGTCAGAGATGCC-3'    (SEQ ID NO: 1284)

5'-CUGCUCCUGAAGUCAGAGAUGCCGC-3'        (SEQ ID NO: 1861)
                3'-AAGACGAGGACUUCAGUCUCUACGGCG-5'      (SEQ ID NO: 709)
CKAP5-1502 Target:5'-TTCTGCTCCTGAAGTCAGAGATGCCGC-3'    (SEQ ID NO: 1285)

5'-GCUCCUGAAGUCAGAGAUGCCGCAU-3'        (SEQ ID NO: 1862)
                3'-GACGAGGACUUCAGUCUCUACGGCGUA-5'      (SEQ ID NO: 710)
CKAP5-1504 Target:5'-CTGCTCCTGAAGTCAGAGATGCCGCAT-3'    (SEQ ID NO: 1286)

5'-GAUCAAAGAAUGUUCAGAAAAGGUA-3'        (SEQ ID NO: 1863)
                3'-UUCUAGUUUCUUACAAGUCUUUUCCAU-5'      (SEQ ID NO: 711)
CKAP5-1617 Target:5'-AAGATCAAAGAATGTTCAGAAAAGGTA-3'    (SEQ ID NO: 1287)

5'-UCAAAGAAUGUUCAGAAAAGGUAGA-3'        (SEQ ID NO: 1864)
                3'-CUAGUUUCUUACAAGUCUUUUCCAUCU-5'      (SEQ ID NO: 712)
CKAP5-1619 Target:5'-GATCAAAGAATGTTCAGAAAAGGTAGA-3'    (SEQ ID NO: 1288)
```

TABLE 3-continued

Selected Human Anti-CKAP5 DsiRNAs, Unmodified Duplexes (Asymmetrics)

```
               5'-AACCUGGAUGGAAAGAAACUAAUUU-3'      (SEQ ID NO: 1865)
               3'-CUUUGGACCUACCUUUCUUUGAUUAAA-5'    (SEQ ID NO: 713)
CKAP5-2090 Target: 5'-GAAACCTGGATGGAAAGAAACTAATTT-3' (SEQ ID NO: 1289)

5'-CCUGGAUGGAAAGAAACUAAUUUUC-3'      (SEQ ID NO: 1866)
               3'-UUGGACCUACCUUUCUUUGAUUAAAAG-5'    (SEQ ID NO: 714)
CKAP5-2092 Target: 5'-AACCTGGATGGAAAGAAACTAATTTTC-3' (SEQ ID NO: 1290)

5'-UGGAUGGAAAGAAACUAAUUUUCAG-3'      (SEQ ID NO: 1867)
               3'-GGACCUACCUUUCUUUGAUUAAAAGUC-5'    (SEQ ID NO: 715)
CKAP5-2094 Target: 5'-CCTGGATGGAAAGAAACTAATTTTCAG-3' (SEQ ID NO: 1291)

5'-GAUGGAAAGAAACUAAUUUUCAGGU-3'      (SEQ ID NO: 1868)
               3'-ACCUACCUUUCUUUGAUUAAAAGUCCA-5'    (SEQ ID NO: 716)
CKAP5-2096 Target: 5'-TGGATGGAAAGAAACTAATTTTCAGGT-3' (SEQ ID NO: 1292)

5'-UGGAAAGAAACUAAUUUUCAGGUGA-3'      (SEQ ID NO: 1869)
               3'-CUACCUUUCUUUGAUUAAAAGUCCACU-5'    (SEQ ID NO: 717)
CKAP5-2098 Target: 5'-GATGGAAAGAAACTAATTTTCAGGTGA-3' (SEQ ID NO: 1293)

5'-GAAAGAAACUAAUUUUCAGGUGAUG-3'      (SEQ ID NO: 1870)
               3'-ACCUUUCUUUGAUUAAAAGUCCACUAC-5'    (SEQ ID NO: 718)
CKAP5-2100 Target: 5'-TGGAAAGAAACTAATTTTCAGGTGATG-3' (SEQ ID NO: 1294)

5'-AAGAAACUAAUUUUCAGGUGAUGCA-3'      (SEQ ID NO: 1871)
               3'-CUUUCUUUGAUUAAAAGUCCACUACGU-5'    (SEQ ID NO: 719)
CKAP5-2102 Target: 5'-GAAAGAAACTAATTTTCAGGTGATGCA-3' (SEQ ID NO: 1295)

5'-GAAACUAAUUUUCAGGUGAUGCAAA-3'      (SEQ ID NO: 1872)
               3'-UUCUUUGAUUAAAAGUCCACUACGUUU-5'    (SEQ ID NO: 720)
CKAP5-2104 Target: 5'-AAGAAACTAATTTTCAGGTGATGCAAA-3' (SEQ ID NO: 1296)

5'-AACUAAUUUUCAGGUGAUGCAAAUG-3'      (SEQ ID NO: 1873)
               3'-CUUUGAUUAAAAGUCCACUACGUUUAC-5'    (SEQ ID NO: 721)
CKAP5-2106 Target: 5'-GAAACTAATTTTCAGGTGATGCAAATG-3' (SEQ ID NO: 1297)

5'-CUAAUUUUCAGGUGAUGCAAAUGAA-3'      (SEQ ID NO: 1874)
               3'-UUGAUUAAAAGUCCACUACGUUUACUU-5'    (SEQ ID NO: 722)
CKAP5-2108 Target: 5'-AACTAATTTTCAGGTGATGCAAATGAA-3' (SEQ ID NO: 1298)

5'-UUGCUUUGAUUGCCCAGAAGGGAAA-3'      (SEQ ID NO: 1875)
               3'-UCAACGAAACUAACGGGUCUUCCCUUU-5'    (SEQ ID NO: 723)
CKAP5-2144 Target: 5'-AGTTGCTTTGATTGCCCAGAAGGGAAA-3' (SEQ ID NO: 1299)

5'-GCUUUGAUUGCCCAGAAGGGAAAUU-3'      (SEQ ID NO: 1876)
               3'-AACGAAACUAACGGGUCUUCCCUUUAA-5'    (SEQ ID NO: 724)
CKAP5-2146 Target: 5'-TTGCTTTGATTGCCCAGAAGGGAAATT-3' (SEQ ID NO: 1300)

5'-UUUGAUUGCCCAGAAGGGAAAUUUU-3'      (SEQ ID NO: 1877)
               3'-CGAAACUAACGGGUCUUCCCUUUAAAA-5'    (SEQ ID NO: 725)
CKAP5-2148 Target: 5'-GCTTTGATTGCCCAGAAGGGAAATTTT-3' (SEQ ID NO: 1301)

5'-UGAUUGCCCAGAAGGGAAAUUUUUC-3'      (SEQ ID NO: 1878)
               3'-AAACUAACGGGUCUUCCCUUUAAAAAG-5'    (SEQ ID NO: 726)
CKAP5-2150 Target: 5'-TTTGATTGCCCAGAAGGGAAATTTTTC-3' (SEQ ID NO: 1302)

5'-AUUGCCCAGAAGGGAAAUUUUUCCA-3'      (SEQ ID NO: 1879)
               3'-ACUAACGGGUCUUCCCUUUAAAAAGGU-5'    (SEQ ID NO: 727)
CKAP5-2152 Target: 5'-TGATTGCCCAGAAGGGAAATTTTTCCA-3' (SEQ ID NO: 1303)

5'-UGCCCAGAAGGGAAAUUUUUCCAAA-3'      (SEQ ID NO: 1880)
               3'-UAACGGGUCUUCCCUUUAAAAAGGUUU-5'    (SEQ ID NO: 728)
CKAP5-2154 Target: 5'-ATTGCCCAGAAGGGAAATTTTTCCAAA-3' (SEQ ID NO: 1304)

5'-CCCAGAAGGGAAAUUUUUCCAAAAC-3'      (SEQ ID NO: 1881)
               3'-ACGGGUCUUCCCUUUAAAAAGGUUUUG-5'    (SEQ ID NO: 729)
CKAP5-2156 Target: 5'-TGCCCAGAAGGGAAATTTTTCCAAAAC-3' (SEQ ID NO: 1305)

5'-GACAAGAUUGGAGAUGUGAAAUGUG-3'      (SEQ ID NO: 1882)
               3'-ACCUGUUCUAACCUCUACACUUUACAC-5'    (SEQ ID NO: 730)
CKAP5-2212 Target: 5'-TGGACAAGATTGGAGATGTGAAATGTG-3' (SEQ ID NO: 1306)

5'-CAAGAUUGGAGAUGUGAAAUGUGGG-3'      (SEQ ID NO: 1883)
               3'-CUGUUCUAACCUCUACACUUUACACCC-5'    (SEQ ID NO: 731)
CKAP5-2214 Target: 5'-GACAAGATTGGAGATGTGAAATGTGGG-3' (SEQ ID NO: 1307)
```

TABLE 3-continued

Selected Human Anti-CKAP5 DsiRNAs, Unmodified Duplexes (Asymmetrics)

```
                5'-AGAUUGGAGAUGUGAAAUGUGGGAA-3'      (SEQ ID NO: 1884)
                3'-GUUCUAACCUCUACACUUUACACCCUU-5'    (SEQ ID NO: 732)
CKAP5-2216 Target: 5'-CAAGATTGGAGATGTGAAATGTGGGAA-3' (SEQ ID NO: 1308)

5'-AUUGGAGAUGUGAAAUGUGGGAACA-3'      (SEQ ID NO: 1885)
                3'-UCUAACCUCUACACUUUACACCCUUGU-5'    (SEQ ID NO: 733)
CKAP5-2218 Target: 5'-AGATTGGAGATGTGAAATGTGGGAACA-3' (SEQ ID NO: 1309)

5'-UGGAGAUGUGAAAUGUGGGAACAAU-3'      (SEQ ID NO: 1886)
                3'-UAACCUCUACACUUUACACCCUUGUUA-5'    (SEQ ID NO: 734)
CKAP5-2220 Target: 5'-ATTGGAGATGTGAAATGTGGGAACAAT-3' (SEQ ID NO: 1310)

5'-GAGAUGUGAAAUGUGGGAACAAUGC-3'      (SEQ ID NO: 1887)
                3'-ACCUCUACACUUUACACCCUUGUUACG-5'    (SEQ ID NO: 735)
CKAP5-2222 Target: 5'-TGGAGATGTGAAATGTGGGAACAATGC-3' (SEQ ID NO: 1311)

5'-GAUGUGAAAUGUGGGAACAAUGCAA-3'      (SEQ ID NO: 1888)
                3'-CUCUACACUUUACACCCUUGUUACGUU-5'    (SEQ ID NO: 736)
CKAP5-2224 Target: 5'-GAGATGTGAAATGTGGGAACAATGCAA-3' (SEQ ID NO: 1312)

5'-UGUGAAAUGUGGGAACAAUGCAAAA-3'      (SEQ ID NO: 1889)
                3'-CUACACUUUACACCCUUGUUACGUUUU-5'    (SEQ ID NO: 737)
CKAP5-2226 Target: 5'-GATGTGAAATGTGGGAACAATGCAAAA-3' (SEQ ID NO: 1313)

5'-UGAAAUGUGGGAACAAUGCAAAAGA-3'      (SEQ ID NO: 1890)
                3'-ACACUUUACACCCUUGUUACGUUUUCU-5'    (SEQ ID NO: 738)
CKAP5-2228 Target: 5'-TGTGAAATGTGGGAACAATGCAAAAGA-3' (SEQ ID NO: 1314)

5'-AAAUGUGGGAACAAUGCAAAAGAAG-3'      (SEQ ID NO: 1891)
                3'-ACUUUACACCCUUGUUACGUUUUCUUC-5'    (SEQ ID NO: 739)
CKAP5-2230 Target: 5'-TGAAATGTGGGAACAATGCAAAAGAAG-3' (SEQ ID NO: 1315)

5'-AUGUGGGAACAAUGCAAAAGAAGCU-3'      (SEQ ID NO: 1892)
                3'-UUUACACCCUUGUUACGUUUUCUUCGA-5'    (SEQ ID NO: 740)
CKAP5-2232 Target: 5'-AAATGTGGGAACAATGCAAAAGAAGCT-3' (SEQ ID NO: 1316)

5'-GUGGGAACAAUGCAAAAGAAGCUAU-3'      (SEQ ID NO: 1893)
                3'-UACACCCUUGUUACGUUUUCUUCGAUA-5'    (SEQ ID NO: 741)
CKAP5-2234 Target: 5'-ATGTGGGAACAATGCAAAAGAAGCTAT-3' (SEQ ID NO: 1317)

5'-GGGAACAAUGCAAAAGAAGCUAUGA-3'      (SEQ ID NO: 1894)
                3'-CACCCUUGUUACGUUUUCUUCGAUACU-5'    (SEQ ID NO: 742)
CKAP5-2236 Target: 5'-GTGGGAACAATGCAAAAGAAGCTATGA-3' (SEQ ID NO: 1318)

5'-GUUGAAUGUCAAAGCUUUCAUUAGC-3'      (SEQ ID NO: 1895)
                3'-CCCAACUUACAGUUUCGAAAGUAAUCG-5'    (SEQ ID NO: 743)
CKAP5-2400 Target: 5'-GGGTTGAATGTCAAAGCTTTCATTAGC-3' (SEQ ID NO: 1319)

5'-UGAAUGUCAAAGCUUUCAUUAGCAA-3'      (SEQ ID NO: 1896)
                3'-CAACUUACAGUUUCGAAAGUAAUCGUU-5'    (SEQ ID NO: 744)
CKAP5-2402 Target: 5'-GTTGAATGTCAAAGCTTTCATTAGCAA-3' (SEQ ID NO: 1320)

5'-AAUGUCAAAGCUUUCAUUAGCAAUG-3'      (SEQ ID NO: 1897)
                3'-ACUUACAGUUUCGAAAGUAAUCGUUAC-5'    (SEQ ID NO: 745)
CKAP5-2404 Target: 5'-TGAATGTCAAAGCTTTCATTAGCAATG-3' (SEQ ID NO: 1321)

5'-UGUCAAAGCUUUCAUUAGCAAUGUG-3'      (SEQ ID NO: 1898)
                3'-UUACAGUUUCGAAAGUAAUCGUUACAC-5'    (SEQ ID NO: 746)
CKAP5-2406 Target: 5'-AATGTCAAAGCTTTCATTAGCAATGTG-3' (SEQ ID NO: 1322)

5'-UCAAAGCUUUCAUUAGCAAUGUGAA-3'      (SEQ ID NO: 1899)
                3'-ACAGUUUCGAAAGUAAUCGUUACACUU-5'    (SEQ ID NO: 747)
CKAP5-2408 Target: 5'-TGTCAAAGCTTTCATTAGCAATGTGAA-3' (SEQ ID NO: 1323)

5'-CCCUGCUUGGCGUGAUGUAUCUGUA-3'      (SEQ ID NO: 1900)
                3'-UUGGGACGAACCGCACUACAUAGACAU-5'    (SEQ ID NO: 748)
CKAP5-2480 Target: 5'-AACCCTGCTTGGCGTGATGTATCTGTA-3' (SEQ ID NO: 1324)

5'-CUGCUUGGCGUGAUGUAUCUGUAUG-3'      (SEQ ID NO: 1901)
                3'-GGGACGAACCGCACUACAUAGACAUAC-5'    (SEQ ID NO: 749)
CKAP5-2482 Target: 5'-CCCTGCTTGGCGTGATGTATCTGTATG-3' (SEQ ID NO: 1325)

5'-UCUUUGAGGAUGAGAAGCCUGCCCU-3'      (SEQ ID NO: 1902)
                3'-CAAGAAACUCCUACUCUUCGGACGGGA-5'    (SEQ ID NO: 750)
CKAP5-2528 Target: 5'-GTTCTTTGAGGATGAGAAGCCTGCCCT-3' (SEQ ID NO: 1326)
```

TABLE 3-continued

Selected Human Anti-CKAP5 DsiRNAs, Unmodified Duplexes (Asymmetrics)

```
                5'-UUUGAGGAUGAGAAGCCUGCCCUCC-3'      (SEQ ID NO: 1903)
                3'-AGAAACUCCUACUCUUCGGACGGGAGG-5'    (SEQ ID NO: 751)
CKAP5-2530 Target:5'-TCTTTGAGGATGAGAAGCCTGCCCTCC-3'  (SEQ ID NO: 1327)

5'-UGAGGAUGAGAAGCCUGCCCUCCUA-3'      (SEQ ID NO: 1904)
                3'-AAACUCCUACUCUUCGGACGGGAGGAU-5'    (SEQ ID NO: 752)
CKAP5-2532 Target:5'-TTTGAGGATGAGAAGCCTGCCCTCCTA-3'  (SEQ ID NO: 1328)

5'-AGGAUGAGAAGCCUGCCCUCCUAUC-3'      (SEQ ID NO: 1905)
                3'-ACUCCUACUCUUCGGACGGGAGGAUAG-5'    (SEQ ID NO: 753)
CKAP5-2534 Target:5'-TGAGGATGAGAAGCCTGCCCTCCTATC-3'  (SEQ ID NO: 1329)

5'-GAUGAGAAGCCUGCCCUCCUAUCCC-3'      (SEQ ID NO: 1906)
                3'-UCCUACUCUUCGGACGGGAGGAUAGGG-5'    (SEQ ID NO: 754)
CKAP5-2536 Target:5'-AGGATGAGAAGCCTGCCCTCCTATCCC-3'  (SEQ ID NO: 1330)

5'-UGAGAAGCCUGCCCUCCUAUCCCAG-3'      (SEQ ID NO: 1907)
                3'-CUACUCUUCGGACGGGAGGAUAGGGUC-5'    (SEQ ID NO: 755)
CKAP5-2538 Target:5'-GATGAGAAGCCTGCCCTCCTATCCCAG-3'  (SEQ ID NO: 1331)

5'-AGAAGCCUGCCCUCCUAUCCCAGAU-3'      (SEQ ID NO: 1908)
                3'-ACUCUUCGGACGGGAGGAUAGGGUCUA-5'    (SEQ ID NO: 756)
CKAP5-2540 Target:5'-TGAGAAGCCTGCCCTCCTATCCCAGAT-3'  (SEQ ID NO: 1332)

5'-AAGCCUGCCCUCCUAUCCCAGAUAG-3'      (SEQ ID NO: 1909)
                3'-UCUUCGGACGGGAGGAUAGGGUCUAUC-5'    (SEQ ID NO: 757)
CKAP5-2542 Target:5'-AGAAGCCTGCCCTCCTATCCCAGATAG-3'  (SEQ ID NO: 1333)

5'-GCCUGCCCUCCUAUCCCAGAUAGAU-3'      (SEQ ID NO: 1910)
                3'-UUCGGACGGGAGGAUAGGGUCUAUCUA-5'    (SEQ ID NO: 758)
CKAP5-2544 Target:5'-AAGCCTGCCCTCCTATCCCAGATAGAT-3'  (SEQ ID NO: 1334)

5'-CUGCCCUCCUAUCCCAGAUAGAUGC-3'      (SEQ ID NO: 1911)
                3'-CGGACGGGAGGAUAGGGUCUAUCUACG-5'    (SEQ ID NO: 759)
CKAP5-2546 Target:5'-GCCTGCCCTCCTATCCCAGATAGATGC-3'  (SEQ ID NO: 1335)

5'-GCCCUCCUAUCCCAGAUAGAUGCAG-3'      (SEQ ID NO: 1912)
                3'-GACGGGAGGAUAGGGUCUAUCUACGUC-5'    (SEQ ID NO: 760)
CKAP5-2548 Target:5'-CTGCCCTCCTATCCCAGATAGATGCAG-3'  (SEQ ID NO: 1336)

5'-CCUCCUAUCCCAGAUAGAUGCAGAA-3'      (SEQ ID NO: 1913)
                3'-CGGGAGGAUAGGGUCUAUCUACGUCUU-5'    (SEQ ID NO: 761)
CKAP5-2550 Target:5'-GCCCTCCTATCCCAGATAGATGCAGAA-3'  (SEQ ID NO: 1337)

5'-UCCUAUCCCAGAUAGAUGCAGAAUU-3'      (SEQ ID NO: 1914)
                3'-GGAGGAUAGGGUCUAUCUACGUCUUAA-5'    (SEQ ID NO: 762)
CKAP5-2552 Target:5'-CCTCCTATCCCAGATAGATGCAGAATT-3'  (SEQ ID NO: 1338)

5'-CUAUCCCAGAUAGAUGCAGAAUUUG-3'      (SEQ ID NO: 1915)
                3'-AGGAUAGGGUCUAUCUACGUCUUAAAC-5'    (SEQ ID NO: 763)
CKAP5-2554 Target:5'-TCCTATCCCAGATAGATGCAGAATTTG-3'  (SEQ ID NO: 1339)

5'-AUCCCAGAUAGAUGCAGAAUUUGAG-3'      (SEQ ID NO: 1916)
                3'-GAUAGGGUCUAUCUACGUCUUAAACUC-5'    (SEQ ID NO: 764)
CKAP5-2556 Target:5'-CTATCCCAGATAGATGCAGAATTTGAG-3'  (SEQ ID NO: 1340)

5'-CCCAGAUAGAUGCAGAAUUUGAGAA-3'      (SEQ ID NO: 1917)
                3'-UAGGGUCUAUCUACGUCUUAAACUCUU-5'    (SEQ ID NO: 765)
CKAP5-2558 Target:5'-ATCCCAGATAGATGCAGAATTTGAGAA-3'  (SEQ ID NO: 1341)

5'-AAGAUGCAGGGACAAAGUCCACCUG-3'      (SEQ ID NO: 1918)
                3'-UCUUCUACGUCCCUGUUUCAGGUGGAC-5'    (SEQ ID NO: 766)
CKAP5-2581 Target:5'-AGAAGATGCAGGGACAAAGTCCACCTG-3'  (SEQ ID NO: 1342)

5'-UACAGAUGAAGGAGAAGAUGGAGAU-3'      (SEQ ID NO: 1919)
                3'-CCAUGUCUACUUCCUCUUCUACCUCUA-5'    (SEQ ID NO: 767)
CKAP5-2643 Target:5'-GGTACAGATGAAGGAGAAGATGGAGAT-3'  (SEQ ID NO: 1343)

5'-CAGAUGAAGGAGAAGAUGGAGAUGA-3'      (SEQ ID NO: 1920)
                3'-AUGUCUACUUCCUCUUCUACCUCUACU-5'    (SEQ ID NO: 768)
CKAP5-2645 Target:5'-TACAGATGAAGGAGAAGATGGAGATGA-3'  (SEQ ID NO: 1344)

5'-GAUGAAGGAGAAGAUGGAGAUGAAC-3'      (SEQ ID NO: 1921)
                3'-GUCUACUUCCUCUUCUACCUCUACUUG-5'    (SEQ ID NO: 769)
CKAP5-2647 Target:5'-CAGATGAAGGAGAAGATGGAGATGAAC-3'  (SEQ ID NO: 1345)
```

TABLE 3-continued

Selected Human Anti-CKAP5 DsiRNAs, Unmodified Duplexes (Asymmetrics)

```
               5'-GUUGAUCUUUUGCCGAGGACGGAGA-3'       (SEQ ID NO: 1922)
               3'-AGCAACUAGAAAACGGCUCCUGCCUCU-5'     (SEQ ID NO: 770)
CKAP5-2695 Target:5'-TCGTTGATCTTTTGCCGAGGACGGAGA-3'  (SEQ ID NO: 1346)

5'-GGAAAGAAGGCCUAGAUGAAGUGGC-3'       (SEQ ID NO: 1923)
               3'-AUCCUUUCUUCCGGAUCUACUUCACCG-5'     (SEQ ID NO: 771)
CKAP5-2780 Target:5'-TAGGAAAGAAGGCCTAGATGAAGTGGC-3'  (SEQ ID NO: 1347)

5'-AAAGAAGGCCUAGAUGAAGUGGCAG-3'       (SEQ ID NO: 1924)
               3'-CCUUUCUUCCGGAUCUACUUCACCGUC-5'     (SEQ ID NO: 772)
CKAP5-2782 Target:5'-GGAAAGAAGGCCTAGATGAAGTGGCAG-3'  (SEQ ID NO: 1348)

5'-AGAAGGCCUAGAUGAAGUGGCAGGU-3'       (SEQ ID NO: 1925)
               3'-UUUCUUCCGGAUCUACUUCACCGUCCA-5'     (SEQ ID NO: 773)
CKAP5-2784 Target:5'-AAAGAAGGCCTAGATGAAGTGGCAGGT-3'  (SEQ ID NO: 1349)

5'-AAGGCCUAGAUGAAGUGGCAGGUAU-3'       (SEQ ID NO: 1926)
               3'-UCUUCCGGAUCUACUUCACCGUCCAUA-5'     (SEQ ID NO: 774)
CKAP5-2786 Target:5'-AGAAGGCCTAGATGAAGTGGCAGGTAT-3'  (SEQ ID NO: 1350)

5'-GGCCUAGAUGAAGUGGCAGGUAUUA-3'       (SEQ ID NO: 1927)
               3'-UUCCGGAUCUACUUCACCGUCCAUAAU-5'     (SEQ ID NO: 775)
CKAP5-2788 Target:5'-AAGGCCTAGATGAAGTGGCAGGTATTA-3'  (SEQ ID NO: 1351)

5'-CCUAGAUGAAGUGGCAGGUAUUAUU-3'       (SEQ ID NO: 1928)
               3'-CCGGAUCUACUUCACCGUCCAUAAUAA-5'     (SEQ ID NO: 776)
CKAP5-2790 Target:5'-GGCCTAGATGAAGTGGCAGGTATTATT-3'  (SEQ ID NO: 1352)

5'-UAGAUGAAGUGGCAGGUAUUAUUAA-3'       (SEQ ID NO: 1929)
               3'-GGAUCUACUUCACCGUCCAUAAUAAUU-5'     (SEQ ID NO: 777)
CKAP5-2792 Target:5'-CCTAGATGAAGTGGCAGGTATTATTAA-3'  (SEQ ID NO: 1353)

5'-GAUGAAGUGGCAGGUAUUAUUAAUG-3'       (SEQ ID NO: 1930)
               3'-AUCUACUUCACCGUCCAUAAUAAUUAC-5'     (SEQ ID NO: 778)
CKAP5-2794 Target:5'-TAGATGAAGTGGCAGGTATTATTAATG-3'  (SEQ ID NO: 1354)

5'-AAUAUAGGUGAACUUCCAACUGCCU-3'       (SEQ ID NO: 1931)
               3'-GCUUAUAUCCACUUGAAGGUUGACGGA-5'     (SEQ ID NO: 779)
CKAP5-2839 Target:5'-CGAATATAGGTGAACTTCCAACTGCCT-3'  (SEQ ID NO: 1355)

5'-UAUAGGUGAACUUCCAACUGCCUUG-3'       (SEQ ID NO: 1932)
               3'-UUAUAUCCACUUGAAGGUUGACGGAAC-5'     (SEQ ID NO: 780)
CKAP5-2841 Target:5'-AATATAGGTGAACTTCCAACTGCCTTG-3'  (SEQ ID NO: 1356)

5'-UAGGUGAACUUCCAACUGCCUUGAA-3'       (SEQ ID NO: 1933)
               3'-AUAUCCACUUGAAGGUUGACGGAACUU-5'     (SEQ ID NO: 781)
CKAP5-2843 Target:5'-TATAGGTGAACTTCCAACTGCCTTGAA-3'  (SEQ ID NO: 1357)

5'-GGUGAACUUCCAACUGCCUUGAAGG-3'       (SEQ ID NO: 1934)
               3'-AUCCACUUGAAGGUUGACGGAACUUCC-5'     (SEQ ID NO: 782)
CKAP5-2845 Target:5'-TAGGTGAACTTCCAACTGCCTTGAAGG-3'  (SEQ ID NO: 1358)

5'-UGAACUUCCAACUGCCUUGAAGGGU-3'       (SEQ ID NO: 1935)
               3'-CCACUUGAAGGUUGACGGAACUUCCCA-5'     (SEQ ID NO: 783)
CKAP5-2847 Target:5'-GGTGAACTTCCAACTGCCTTGAAGGGT-3'  (SEQ ID NO: 1359)

5'-AACUUCCAACUGCCUUGAAGGGUCG-3'       (SEQ ID NO: 1936)
               3'-ACUUGAAGGUUGACGGAACUUCCCAGC-5'     (SEQ ID NO: 784)
CKAP5-2849 Target:5'-TGAACTTCCAACTGCCTTGAAGGGTCG-3'  (SEQ ID NO: 1360)

5'-CUUCCAACUGCCUUGAAGGGUCGAC-3'       (SEQ ID NO: 1937)
               3'-UUGAAGGUUGACGGAACUUCCCAGCUG-5'     (SEQ ID NO: 785)
CKAP5-2851 Target:5'-AACTTCCAACTGCCTTGAAGGGTCGAC-3'  (SEQ ID NO: 1361)

5'-UCCAACUGCCUUGAAGGGUCGACUC-3'       (SEQ ID NO: 1938)
               3'-GAAGGUUGACGGAACUUCCCAGCUGAG-5'     (SEQ ID NO: 786)
CKAP5-2853 Target:5'-CTTCCAACTGCCTTGAAGGGTCGACTC-3'  (SEQ ID NO: 1362)

5'-CAACUGCCUUGAAGGGUCGACUCAA-3'       (SEQ ID NO: 1939)
               3'-AGGUUGACGGAACUUCCCAGCUGAGUU-5'     (SEQ ID NO: 787)
CKAP5-2855 Target:5'-TCCAACTGCCTTGAAGGGTCGACTCAA-3'  (SEQ ID NO: 1363)

5'-ACUGCCUUGAAGGGUCGACUCAAUG-3'       (SEQ ID NO: 1940)
               3'-GUUGACGGAACUUCCCAGCUGAGUUAC-5'     (SEQ ID NO: 788)
CKAP5-2857 Target:5'-CAACTGCCTTGAAGGGTCGACTCAATG-3'  (SEQ ID NO: 1364)
```

TABLE 3-continued

Selected Human Anti-CKAP5 DsiRNAs, Unmodified Duplexes (Asymmetrics)

|  |  |  |
|---|---|---|
|  | 5'-CAACUGGCAGUAGCCAUGGGCCCAA-3' | (SEQ ID NO: 1941) |
|  | 3'-UUGUUGACCGUCAUCGGUACCCGGGUU-5' | (SEQ ID NO: 789) |
| CKAP5-2926 Target: | 5'-AACAACTGGCAGTAGCCATGGGCCCAA-3' | (SEQ ID NO: 1365) |
|  | 5'-AGCAAGAACAAUGUUCGAGCUGCUG-3' | (SEQ ID NO: 1942) |
|  | 3'-UGUCGUUCUUGUUACAAGCUCGACGAC-5' | (SEQ ID NO: 790) |
| CKAP5-3007 Target: | 5'-ACAGCAAGAACAATGTTCGAGCTGCTG-3' | (SEQ ID NO: 1366) |
|  | 5'-CAAGAACAAUGUUCGAGCUGCUGCC-3' | (SEQ ID NO: 1943) |
|  | 3'-UCGUUCUUGUUACAAGCUCGACGACGG-5' | (SEQ ID NO: 791) |
| CKAP5-3009 Target: | 5'-AGCAAGAACAATGTTCGAGCTGCTGCC-3' | (SEQ ID NO: 1367) |
|  | 5'-AGAACAAUGUUCGAGCUGCUGCCCU-3' | (SEQ ID NO: 1944) |
|  | 3'-GUUCUUGUUACAAGCUCGACGACGGGA-5' | (SEQ ID NO: 792) |
| CKAP5-3011 Target: | 5'-CAAGAACAATGTTCGAGCTGCTGCCCT-3' | (SEQ ID NO: 1368) |
|  | 5'-AACAAUGUUCGAGCUGCUGCCCUAG-3' | (SEQ ID NO: 1945) |
|  | 3'-UCUUGUUACAAGCUCGACGACGGGAUC-5' | (SEQ ID NO: 793) |
| CKAP5-3013 Target: | 5'-AGAACAATGTTCGAGCTGCTGCCCTAG-3' | (SEQ ID NO: 1369) |
|  | 5'-CAAUGUUCGAGCUGCUGCCCUAGCG-3' | (SEQ ID NO: 1946) |
|  | 3'-UUGUUACAAGCUCGACGACGGGAUCGC-5' | (SEQ ID NO: 794) |
| CKAP5-3015 Target: | 5'-AACAATGTTCGAGCTGCTGCCCTAGCG-3' | (SEQ ID NO: 1370) |
|  | 5'-AUGUUCGAGCUGCUGCCCUAGCGAC-3' | (SEQ ID NO: 1947) |
|  | 3'-GUUACAAGCUCGACGACGGGAUCGCUG-5' | (SEQ ID NO: 795) |
| CKAP5-3017 Target: | 5'-CAATGTTCGAGCTGCTGCCCTAGCGAC-3' | (SEQ ID NO: 1371) |
|  | 5'-GUUCGAGCUGCUGCCCUAGCGACUG-3' | (SEQ ID NO: 1948) |
|  | 3'-UACAAGCUCGACGACGGGAUCGCUGAC-5' | (SEQ ID NO: 796) |
| CKAP5-3019 Target: | 5'-ATGTTCGAGCTGCTGCCCTAGCGACTG-3' | (SEQ ID NO: 1372) |
|  | 5'-ACUGUGAAUGCUUGGGCAGAACAGA-3' | (SEQ ID NO: 1949) |
|  | 3'-GCUGACACUUACGAACCCGUCUUGUCU-5' | (SEQ ID NO: 797) |
| CKAP5-3040 Target: | 5'-CGACTGTGAATGCTTGGGCAGAACAGA-3' | (SEQ ID NO: 1373) |
|  | 5'-UGUGAAUGCUUGGGCAGAACAGACU-3' | (SEQ ID NO: 1950) |
|  | 3'-UGACACUUACGAACCCGUCUUGUCUGA-5' | (SEQ ID NO: 798) |
| CKAP5-3042 Target: | 5'-ACTGTGAATGCTTGGGCAGAACAGACT-3' | (SEQ ID NO: 1374) |
|  | 5'-UGAAUGCUUGGGCAGAACAGACUGG-3' | (SEQ ID NO: 1951) |
|  | 3'-ACACUUACGAACCCGUCUUGUCUGACC-5' | (SEQ ID NO: 799) |
| CKAP5-3044 Target: | 5'-TGTGAATGCTTGGGCAGAACAGACTGG-3' | (SEQ ID NO: 1375) |
|  | 5'-GAGAAGAUCUUUCUGAAGAGCUCAA-3' | (SEQ ID NO: 1952) |
|  | 3'-UCCUCUUCUAGAAAGACUUCUCGAGUU-5' | (SEQ ID NO: 800) |
| CKAP5-3089 Target: | 5'-AGGAGAAGATCTTTCTGAAGAGCTCAA-3' | (SEQ ID NO: 1376) |
|  | 5'-CUAGAAGAUCGAAAUGGAGAUGUGC-3' | (SEQ ID NO: 1953) |
|  | 3'-CGGAUCUUCUAGCUUUACCUCUACACG-5' | (SEQ ID NO: 801) |
| CKAP5-3229 Target: | 5'-GCCTAGAAGATCGAAATGGAGATGTGC-3' | (SEQ ID NO: 1377) |
|  | 5'-AGAAGAUCGAAAUGGAGAUGUGCGA-3' | (SEQ ID NO: 1954) |
|  | 3'-GAUCUUCUAGCUUUACCUCUACACGCU-5' | (SEQ ID NO: 802) |
| CKAP5-3231 Target: | 5'-CTAGAAGATCGAAATGGAGATGTGCGA-3' | (SEQ ID NO: 1378) |
|  | 5'-AAGAUCGAAAUGGAGAUGUGCGAAA-3' | (SEQ ID NO: 1955) |
|  | 3'-UCUUCUAGCUUUACCUCUACACGCUUU-5' | (SEQ ID NO: 803) |
| CKAP5-3233 Target: | 5'-AGAAGATCGAAATGGAGATGTGCGAAA-3' | (SEQ ID NO: 1379) |
|  | 5'-UGAUGCAUUUAGGAUAUGAAAAAAU-3' | (SEQ ID NO: 1956) |
|  | 3'-GUACUACGUAAAUCCUAUACUUUUUUA-5' | (SEQ ID NO: 804) |
| CKAP5-3287 Target: | 5'-CATGATGCATTTAGGATATGAAAAAAT-3' | (SEQ ID NO: 1380) |
|  | 5'-AUGCAUUUAGGAUAUGAAAAAAUGG-3' | (SEQ ID NO: 1957) |
|  | 3'-ACUACGUAAAUCCUAUACUUUUUUACC-5' | (SEQ ID NO: 805) |
| CKAP5-3289 Target: | 5'-TGATGCATTTAGGATATGAAAAAATGG-3' | (SEQ ID NO: 1381) |
|  | 5'-GCAUUUAGGAUAUGAAAAAAUGGCC-3' | (SEQ ID NO: 1958) |
|  | 3'-UACGUAAAUCCUAUACUUUUUUACCGG-5' | (SEQ ID NO: 806) |
| CKAP5-3291 Target: | 5'-ATGCATTTAGGATATGAAAAAATGGCC-3' | (SEQ ID NO: 1382) |
|  | 5'-AUUUAGGAUAUGAAAAAAUGGCCAA-3' | (SEQ ID NO: 1959) |
|  | 3'-CGUAAAUCCUAUACUUUUUUACCGGUU-5' | (SEQ ID NO: 807) |
| CKAP5-3293 Target: | 5'-GCATTTAGGATATGAAAAAATGGCCAA-3' | (SEQ ID NO: 1383) |

TABLE 3-continued

Selected Human Anti-CKAP5 DsiRNAs, Unmodified Duplexes (Asymmetrics)

```
                5'-UUAGGAUAUGAAAAAAUGGCCAAGG-3'   (SEQ ID NO: 1960)
                3'-UAAAUCCUAUACUUUUUUACCGGUUCC-5' (SEQ ID NO: 808)
CKAP5-3295 Target: 5'-ATTTAGGATATGAAAAAATGGCCAAGG-3' (SEQ ID NO: 1384)

5'-AAGGCUACUGGGAAACUAAAGCCAA-3'   (SEQ ID NO: 1961)
                3'-GGUUCCGAUGACCCUUUGAUUUCGGUU-5' (SEQ ID NO: 809)
CKAP5-3316 Target: 5'-CCAAGGCTACTGGGAAACTAAAGCCAA-3' (SEQ ID NO: 1385)

5'-GGCUACUGGGAAACUAAAGCCAACU-3'   (SEQ ID NO: 1962)
                3'-UUCCGAUGACCCUUUGAUUUCGGUUGA-5' (SEQ ID NO: 810)
CKAP5-3318 Target: 5'-AAGGCTACTGGGAAACTAAAGCCAACT-3' (SEQ ID NO: 1386)

5'-CUACUGGGAAACUAAAGCCAACUUC-3'   (SEQ ID NO: 1963)
                3'-CCGAUGACCCUUUGAUUUCGGUUGAAG-5' (SEQ ID NO: 811)
CKAP5-3320 Target: 5'-GGCTACTGGGAAACTAAAGCCAACTTC-3' (SEQ ID NO: 1387)

5'-ACUGGGAAACUAAAGCCAACUUCUA-3'   (SEQ ID NO: 1964)
                3'-GAUGACCCUUUGAUUUCGGUUGAAGAU-5' (SEQ ID NO: 812)
CKAP5-3322 Target: 5'-CTACTGGGAAACTAAAGCCAACTTCTA-3' (SEQ ID NO: 1388)

5'-UGGGAAACUAAAGCCAACUUCUAAA-3'   (SEQ ID NO: 1965)
                3'-UGACCCUUUGAUUUCGGUUGAAGAUUU-5' (SEQ ID NO: 813)
CKAP5-3324 Target: 5'-ACTGGGAAACTAAAGCCAACTTCTAAA-3' (SEQ ID NO: 1389)

5'-GGAAACUAAAGCCAACUUCUAAAGA-3'   (SEQ ID NO: 1966)
                3'-ACCCUUUGAUUUCGGUUGAAGAUUUCU-5' (SEQ ID NO: 814)
CKAP5-3326 Target: 5'-TGGGAAACTAAAGCCAACTTCTAAAGA-3' (SEQ ID NO: 1390)

5'-AAACUAAAGCCAACUUCUAAAGAUC-3'   (SEQ ID NO: 1967)
                3'-CCUUUGAUUUCGGUUGAAGAUUUCUAG-5' (SEQ ID NO: 815)
CKAP5-3328 Target: 5'-GGAAACTAAAGCCAACTTCTAAAGATC-3' (SEQ ID NO: 1391)

5'-ACUAAAGCCAACUUCUAAAGAUCAG-3'   (SEQ ID NO: 1968)
                3'-UUUGAUUUCGGUUGAAGAUUUCUAGUC-5' (SEQ ID NO: 816)
CKAP5-3330 Target: 5'-AAACTAAAGCCAACTTCTAAAGATCAG-3' (SEQ ID NO: 1392)

5'-UAAAGCCAACUUCUAAAGAUCAGGU-3'   (SEQ ID NO: 1969)
                3'-UGAUUUCGGUUGAAGAUUUCUAGUCCA-5' (SEQ ID NO: 817)
CKAP5-3332 Target: 5'-ACTAAAGCCAACTTCTAAAGATCAGGT-3' (SEQ ID NO: 1393)

5'-AAGCCAACUUCUAAAGAUCAGGUAU-3'   (SEQ ID NO: 1970)
                3'-AUUUCGGUUGAAGAUUUCUAGUCCAUA-5' (SEQ ID NO: 818)
CKAP5-3334 Target: 5'-TAAAGCCAACTTCTAAAGATCAGGTAT-3' (SEQ ID NO: 1394)

5'-CCUAUUUUAUUGUUGUUCCAAAUG-3'    (SEQ ID NO: 1971)
                3'-CCGGAUAAAAAUAACAACAAGGUUUAC-5' (SEQ ID NO: 819)
CKAP5-3625 Target: 5'-GGCCTATTTTATTGTTGTTCCAAATG-3' (SEQ ID NO: 1395)

5'-UAUUUUUAUUGUUGUUCCAAAUGGA-3'   (SEQ ID NO: 1972)
                3'-GGAUAAAAAUAACAACAAGGUUUACCU-5' (SEQ ID NO: 820)
CKAP5-3627 Target: 5'-CCTATTTTTATTGTTGTTCCAAATGGA-3' (SEQ ID NO: 1396)

5'-UUUUUAUUGUUGUUCCAAAUGGAAA-3'   (SEQ ID NO: 1973)
                3'-AUAAAAAUAACAACAAGGUUUACCUUU-5' (SEQ ID NO: 821)
CKAP5-3629 Target: 5'-TATTTTTATTGTTGTTCCAAATGGAAA-3' (SEQ ID NO: 1397)

5'-UUUUAUUGUUGUUCCAAAUGGAAAG-3'   (SEQ ID NO: 1974)
                3'-AAAAAUAACAACAAGGUUUACCUUUUC-5' (SEQ ID NO: 822)
CKAP5-3631 Target: 5'-TTTTTATTGTTGTTCCAAATGGAAAG-3' (SEQ ID NO: 1398)

5'-UAUUGUUGUUCCAAAUGGAAAGAG-3'    (SEQ ID NO: 1975)
                3'-AAAUAACAACAAGGUUUACCUUUUCUC-5' (SEQ ID NO: 823)
CKAP5-3633 Target: 5'-TTTATTGTTGTTCCAAATGGAAAGAG-3' (SEQ ID NO: 1399)

5'-UUGUUGUUCCAAAUGGAAAGAGCA-3'    (SEQ ID NO: 1976)
                3'-AUAACAACAAGGUUUACCUUUUCUCGU-5' (SEQ ID NO: 824)
CKAP5-3635 Target: 5'-TATTGTTGTTCCAAATGGAAAGAGCA-3' (SEQ ID NO: 1400)

5'-AGGUGCUAAAGUGGAAUUUUACUAC-3'   (SEQ ID NO: 1977)
                3'-CUUCCACGAUUUCACCUUAAAAUGAUG-5' (SEQ ID NO: 825)
CKAP5-3686 Target: 5'-GAAGGTGCTAAAGTGGAATTTTACTAC-3' (SEQ ID NO: 1401)

5'-GUGCUAAAGUGGAAUUUUACUACCC-3'   (SEQ ID NO: 1978)
                3'-UCCCACGAUUUCACCUUAAAAUGAUGGG-5' (SEQ ID NO: 826)
CKAP5-3688 Target: 5'-AGGTGCTAAAGTGGAATTTTACTACCC-3' (SEQ ID NO: 1402)
```

TABLE 3-continued

Selected Human Anti-CKAP5 DsiRNAs, Unmodified Duplexes (Asymmetrics)

|  |  |  |
|---|---|---|
| CKAP5-3989 | 5'-AUCAUCUUACUGAGAAUGAAGCAUC-3'<br>3'-UAUAGUAGAAUGACUCUUACUUCGUAG-5'<br>Target: 5'-ATATCATCTTACTGAGAATGAAGCATC-3' | (SEQ ID NO: 1979)<br>(SEQ ID NO: 827)<br>(SEQ ID NO: 1403) |
| CKAP5-3991 | 5'-CAUCUUACUGAGAAUGAAGCAUCUU-3'<br>3'-UAGUAGAAUGACUCUUACUUCGUAGAA-5'<br>Target: 5'-ATCATCTTACTGAGAATGAAGCATCTT-3' | (SEQ ID NO: 1980)<br>(SEQ ID NO: 828)<br>(SEQ ID NO: 1404) |
| CKAP5-3993 | 5'-UCUUACUGAGAAUGAAGCAUCUUCC-3'<br>3'-GUAGAAUGACUCUUACUUCGUAGAAGG-5'<br>Target: 5'-CATCTTACTGAGAATGAAGCATCTTCC-3' | (SEQ ID NO: 1981)<br>(SEQ ID NO: 829)<br>(SEQ ID NO: 1405) |
| CKAP5-3995 | 5'-UUACUGAGAAUGAAGCAUCUUCCUU-3'<br>3'-AGAAUGACUCUUACUUCGUAGAAGGAA-5'<br>Target: 5'-TCTTACTGAGAATGAAGCATCTTCCTT-3' | (SEQ ID NO: 1982)<br>(SEQ ID NO: 830)<br>(SEQ ID NO: 1406) |
| CKAP5-4038 | 5'-CAAGGUUGGAGAACCAAAGGAUGUC-3'<br>3'-CAGUUCCAACCUCUUGGUUUCCUACAG-5'<br>Target: 5'-GTCAAGGTTGGAGAACCAAAGGATGTC-3' | (SEQ ID NO: 1983)<br>(SEQ ID NO: 831)<br>(SEQ ID NO: 1407) |
| CKAP5-4040 | 5'-AGGUUGGAGAACCAAAGGAUGUCAU-3'<br>3'-GUUCCAACCUCUUGGUUUCCUACAGUA-5'<br>Target: 5'-CAAGGTTGGAGAACCAAAGGATGTCAT-3' | (SEQ ID NO: 1984)<br>(SEQ ID NO: 832)<br>(SEQ ID NO: 1408) |
| CKAP5-4042 | 5'-GUUGGAGAACCAAAGGAUGUCAUUC-3'<br>3'-UCCAACCUCUUGGUUUCCUACAGUAAG-5'<br>Target: 5'-AGGTTGGAGAACCAAAGGATGTCATTC-3' | (SEQ ID NO: 1985)<br>(SEQ ID NO: 833)<br>(SEQ ID NO: 1409) |
| CKAP5-4044 | 5'-UGGAGAACCAAAGGAUGUCAUUCGU-3'<br>3'-CAACCUCUUGGUUUCCUACAGUAAGCA-5'<br>Target: 5'-GTTGGAGAACCAAAGGATGTCATTCGT-3' | (SEQ ID NO: 1986)<br>(SEQ ID NO: 834)<br>(SEQ ID NO: 1410) |
| CKAP5-4046 | 5'-GAGAACCAAAGGAUGUCAUUCGUAA-3'<br>3'-ACCUCUUGGUUUCCUACAGUAAGCAUU-5'<br>Target: 5'-TGGAGAACCAAAGGATGTCATTCGTAA-3' | (SEQ ID NO: 1987)<br>(SEQ ID NO: 835)<br>(SEQ ID NO: 1411) |
| CKAP5-4048 | 5'-GAACCAAAGGAUGUCAUUCGUAAAG-3'<br>3'-CUCUUGGUUUCCUACAGUAAGCAUUUC-5'<br>Target: 5'-GAGAACCAAAGGATGTCATTCGTAAAG-3' | (SEQ ID NO: 1988)<br>(SEQ ID NO: 836)<br>(SEQ ID NO: 1412) |
| CKAP5-4050 | 5'-ACCAAAGGAUGUCAUUCGUAAAGAU-3'<br>3'-CUUGGUUUCCUACAGUAAGCAUUUCUA-5'<br>Target: 5'-GAACCAAAGGATGTCATTCGTAAAGAT-3' | (SEQ ID NO: 1989)<br>(SEQ ID NO: 837)<br>(SEQ ID NO: 1413) |
| CKAP5-4052 | 5'-CAAAGGAUGUCAUUCGUAAAGAUGU-3'<br>3'-UGGUUUCCUACAGUAAGCAUUUCUACA-5'<br>Target: 5'-ACCAAAGGATGTCATTCGTAAAGATGT-3' | (SEQ ID NO: 1990)<br>(SEQ ID NO: 838)<br>(SEQ ID NO: 1414) |
| CKAP5-4054 | 5'-AAGGAUGUCAUUCGUAAAGAUGUUC-3'<br>3'-GUUUCCUACAGUAAGCAUUUCUACAAG-5'<br>Target: 5'-CAAAGGATGTCATTCGTAAAGATGTTC-3' | (SEQ ID NO: 1991)<br>(SEQ ID NO: 839)<br>(SEQ ID NO: 1415) |
| CKAP5-4056 | 5'-GGAUGUCAUUCGUAAAGAUGUUCGU-3'<br>3'-UUCCUACAGUAAGCAUUUCUACAAGCA-5'<br>Target: 5'-AAGGATGTCATTCGTAAAGATGTTCGT-3' | (SEQ ID NO: 1992)<br>(SEQ ID NO: 840)<br>(SEQ ID NO: 1416) |
| CKAP5-4058 | 5'-AUGUCAUUCGUAAAGAUGUUCGUGC-3'<br>3'-CCUACAGUAAGCAUUUCUACAAGCACG-5'<br>Target: 5'-GGATGTCATTCGTAAAGATGTTCGTGC-3' | (SEQ ID NO: 1993)<br>(SEQ ID NO: 841)<br>(SEQ ID NO: 1417) |
| CKAP5-4085 | 5'-UCCUGAACCGGAUGUGCCUUGUCUA-3'<br>3'-GUAGGACUUGGCCUACACGGAACAGAU-5'<br>Target: 5'-CATCCTGAACCGGATGTGCCTTGTCTA-3' | (SEQ ID NO: 1994)<br>(SEQ ID NO: 842)<br>(SEQ ID NO: 1418) |
| CKAP5-4087 | 5'-CUGAACCGGAUGUGCCUUGUCUACC-3'<br>3'-AGGACUUGGCCUACACGGAACAGAUGG-5'<br>Target: 5'-TCCTGAACCGGATGTGCCTTGTCTACC-3' | (SEQ ID NO: 1995)<br>(SEQ ID NO: 843)<br>(SEQ ID NO: 1419) |
| CKAP5-4089 | 5'-GAACCGGAUGUGCCUUGUCUACCCA-3'<br>3'-GACUUGGCCUACACGGAACAGAUGGGU-5'<br>Target: 5'-CTGAACCGGATGTGCCTTGTCTACCCA-3' | (SEQ ID NO: 1996)<br>(SEQ ID NO: 844)<br>(SEQ ID NO: 1420) |
| CKAP5-4091 | 5'-ACCGGAUGUGCCUUGUCUACCCAGC-3'<br>3'-CUUGGCCUACACGGAACAGAUGGGUCG-5'<br>Target: 5'-GAACCGGATGTGCCTTGTCTACCCAGC-3' | (SEQ ID NO: 1997)<br>(SEQ ID NO: 845)<br>(SEQ ID NO: 1421) |

TABLE 3-continued

Selected Human Anti-CKAP5 DsiRNAs, Unmodified Duplexes (Asymmetrics)

|  |  |  |
|---|---|---|
|  | 5'-CGGAUGUGCCUUGUCUACCCAGCUA-3' | (SEQ ID NO: 1998) |
|  | 3'-UGGCCUACACGGAACAGAUGGGUCGAU-5' | (SEQ ID NO: 846) |
| CKAP5-4093 Target: | 5'-ACCGGATGTGCCTTGTCTACCCAGCTA-3' | (SEQ ID NO: 1422) |
|  | 5'-GAUGUGCCUUGUCUACCCAGCUAGC-3' | (SEQ ID NO: 1999) |
|  | 3'-GCCUACACGGAACAGAUGGGUCGAUCG-5' | (SEQ ID NO: 847) |
| CKAP5-4095 Target: | 5'-CGGATGTGCCTTGTCTACCCAGCTAGC-3' | (SEQ ID NO: 1423) |
|  | 5'-UGUGCCUUGUCUACCCAGCUAGCAA-3' | (SEQ ID NO: 2000) |
|  | 3'-CUACACGGAACAGAUGGGUCGAUCGUU-5' | (SEQ ID NO: 848) |
| CKAP5-4097 Target: | 5'-GATGTGCCTTGTCTACCCAGCTAGCAA-3' | (SEQ ID NO: 1424) |
|  | 5'-CCAAAAACUCUAAGCAGAGAGCAGA-3' | (SEQ ID NO: 2001) |
|  | 3'-UAGGUUUUUGAGAUUCGUCUCUCGUCU-5' | (SEQ ID NO: 849) |
| CKAP5-4154 Target: | 5'-ATCCAAAACTCTAAGCAGAGAGCAGA-3' | (SEQ ID NO: 1425) |
|  | 5'-AAAAACUCUAAGCAGAGAGCAGAGU-3' | (SEQ ID NO: 2002) |
|  | 3'-GGUUUUUGAGAUUCGUCUCUCGUCUCA-5' | (SEQ ID NO: 850) |
| CKAP5-4156 Target: | 5'-CCAAAAACTCTAAGCAGAGAGCAGAGT-3' | (SEQ ID NO: 1426) |
|  | 5'-AAACUCUAAGCAGAGAGCAGAGUGC-3' | (SEQ ID NO: 2003) |
|  | 3'-UUUUUGAGAUUCGUCUCUCGUCUCACG-5' | (SEQ ID NO: 851) |
| CKAP5-4158 Target: | 5'-AAAAACTCTAAGCAGAGAGCAGAGTGC-3' | (SEQ ID NO: 1427) |
|  | 5'-ACUCUAAGCAGAGAGCAGAGUGCCU-3' | (SEQ ID NO: 2004) |
|  | 3'-UUUGAGAUUCGUCUCUCGUCUCACGGA-5' | (SEQ ID NO: 852) |
| CKAP5-4160 Target: | 5'-AAACTCTAAGCAGAGAGCAGAGTGCCT-3' | (SEQ ID NO: 1428) |
|  | 5'-UCUAAGCAGAGAGCAGAGUGCCUGG-3' | (SEQ ID NO: 2005) |
|  | 3'-UGAGAUUCGUCUCUCGUCUCACGGACC-5' | (SEQ ID NO: 853) |
| CKAP5-4162 Target: | 5'-ACTCTAAGCAGAGAGCAGAGTGCCTGG-3' | (SEQ ID NO: 1429) |
|  | 5'-UAAGCAGAGAGCAGAGUGCCUGGAA-3' | (SEQ ID NO: 2006) |
|  | 3'-AGAUUCGUCUCUCGUCUCACGGACCUU-5' | (SEQ ID NO: 854) |
| CKAP5-4164 Target: | 5'-TCTAAGCAGAGAGCAGAGTGCCTGGAA-3' | (SEQ ID NO: 1430) |
|  | 5'-AGCAGAGAGCAGAGUGCCUGGAAGA-3' | (SEQ ID NO: 2007) |
|  | 3'-AUUCGUCUCUCGUCUCACGGACCUUCU-5' | (SEQ ID NO: 855) |
| CKAP5-4166 Target: | 5'-TAAGCAGAGAGCAGAGTGCCTGGAAGA-3' | (SEQ ID NO: 1431) |
|  | 5'-CAGAGAGCAGAGUGCCUGGAAGAGC-3' | (SEQ ID NO: 2008) |
|  | 3'-UCGUCUCUCGUCUCACGGACCUUCUCG-5' | (SEQ ID NO: 856) |
| CKAP5-4168 Target: | 5'-AGCAGAGAGCAGAGTGCCTGGAAGAGC-3' | (SEQ ID NO: 1432) |
|  | 5'-GAGAGCAGAGUGCCUGGAAGAGCUG-3' | (SEQ ID NO: 2009) |
|  | 3'-GUCUCUCGUCUCACGGACCUUCUCGAC-5' | (SEQ ID NO: 857) |
| CKAP5-4170 Target: | 5'-CAGAGAGCAGAGTGCCTGGAAGAGCTG-3' | (SEQ ID NO: 1433) |
|  | 5'-GAGCAGAGUGCCUGGAAGAGCUGGG-3' | (SEQ ID NO: 2010) |
|  | 3'-CUCUCGUCUCACGGACCUUCUCGACCC-5' | (SEQ ID NO: 858) |
| CKAP5-4172 Target: | 5'-GAGAGCAGAGTGCCTGGAAGAGCTGGG-3' | (SEQ ID NO: 1434) |
|  | 5'-GCAGAGUGCCUGGAAGAGCUGGGAU-3' | (SEQ ID NO: 2011) |
|  | 3'-CUCGUCUCACGGACCUUCUCGACCCUA-5' | (SEQ ID NO: 859) |
| CKAP5-4174 Target: | 5'-GAGCAGAGTGCCTGGAAGAGCTGGGAT-3' | (SEQ ID NO: 1435) |
|  | 5'-CAGGAAAAGCCUUAAAGGAAAUAGC-3' | (SEQ ID NO: 2012) |
|  | 3'-GGGUCCUUUUCGGAAUUUCCUUUAUCG-5' | (SEQ ID NO: 860) |
| CKAP5-4241 Target: | 5'-CCCAGGAAAAGCCTTAAAGGAAATAGC-3' | (SEQ ID NO: 1436) |
|  | 5'-AUCAGGUGUUCAAACUGAUUGGAAA-3' | (SEQ ID NO: 2013) |
|  | 3'-CCUAGUCCACAAGUUUGACUAACCUUU-5' | (SEQ ID NO: 861) |
| CKAP5-4346 Target: | 5'-GGATCAGGTGTTCAAACTGATTGGAAA-3' | (SEQ ID NO: 1437) |
|  | 5'-CAGGUGUUCAAACUGAUUGGAAAUC-3' | (SEQ ID NO: 2014) |
|  | 3'-UAGUCCACAAGUUUGACUAACCUUUAG-5' | (SEQ ID NO: 862) |
| CKAP5-4348 Target: | 5'-ATCAGGTGTTCAAACTGATTGGAAATC-3' | (SEQ ID NO: 1438) |
|  | 5'-GGUGUUCAAACUGAUUGGAAAUCUU-3' | (SEQ ID NO: 2015) |
|  | 3'-GUCCACAAGUUUGACUAACCUUUAGAA-5' | (SEQ ID NO: 863) |
| CKAP5-4350 Target: | 5'-CAGGTGTTCAAACTGATTGGAAATCTT-3' | (SEQ ID NO: 1439) |
|  | 5'-UGUUCAAACUGAUUGGAAAUCUUUC-3' | (SEQ ID NO: 2016) |
|  | 3'-CCACAAGUUUGACUAACCUUUAGAAAG-5' | (SEQ ID NO: 864) |
| CKAP5-4352 Target: | 5'-GGTGTTCAAACTGATTGGAAATCTTTC-3' | (SEQ ID NO: 1440) |

TABLE 3-continued

Selected Human Anti-CKAP5 DsiRNAs, Unmodified Duplexes (Asymmetrics)

```
                5'-UUCAAACUGAUUGGAAAUCUUUCUG-3'     (SEQ ID NO: 2017)
                3'-ACAAGUUUGACUAACCUUUAGAAAGAC-5'   (SEQ ID NO: 865)
CKAP5-4354 Target:5'-TGTTCAAACTGATTGGAAATCTTTCTG-3' (SEQ ID NO: 1441)

5'-CAAACUGAUUGGAAAUCUUUCUGAA-3'     (SEQ ID NO: 2018)
                3'-AAGUUUGACUAACCUUUAGAAAGACUU-5'   (SEQ ID NO: 866)
CKAP5-4356 Target:5'-TTCAAACTGATTGGAAATCTTTCTGAA-3' (SEQ ID NO: 1442)

5'-AACUGAUUGGAAAUCUUUCUGAAAA-3'     (SEQ ID NO: 2019)
                3'-GUUUGACUAACCUUUAGAAAGACUUUU-5'   (SEQ ID NO: 867)
CKAP5-4358 Target:5'-CAAACTGATTGGAAATCTTTCTGAAAA-3' (SEQ ID NO: 1443)

5'-CUGAUUGGAAAUCUUUCUGAAAAGG-3'     (SEQ ID NO: 2020)
                3'-UUGACUAACCUUUAGAAAGACUUUUCC-5'   (SEQ ID NO: 868)
CKAP5-4360 Target:5'-AACTGATTGGAAATCTTTCTGAAAAGG-3' (SEQ ID NO: 1444)

5'-AAGCGGUCAGCAAAGAGACCCUCUG-3'     (SEQ ID NO: 2021)
                3'-AAUUCGCCAGUCGUUUCUCUGGGAGAC-5'   (SEQ ID NO: 869)
CKAP5-4411 Target:5'-TTAAGCGGTCAGCAAAGAGACCCTCTG-3' (SEQ ID NO: 1445)

5'-GCGGUCAGCAAAGAGACCCUCUGCU-3'     (SEQ ID NO: 2022)
                3'-UUCGCCAGUCGUUUCUCUGGGAGACGA-5'   (SEQ ID NO: 870)
CKAP5-4413 Target:5'-AAGCGGTCAGCAAAGAGACCCTCTGCT-3' (SEQ ID NO: 1446)

5'-GGUCAGCAAAGAGACCCUCUGCUGC-3'     (SEQ ID NO: 2023)
                3'-CGCCAGUCGUUUCUCUGGGAGACGACG-5'   (SEQ ID NO: 871)
CKAP5-4415 Target:5'-GCGGTCAGCAAAGAGACCCTCTGCTGC-3' (SEQ ID NO: 1447)

5'-UCAGCAAAGAGACCCUCUGCUGCAC-3'     (SEQ ID NO: 2024)
                3'-CCAGUCGUUUCUCUGGGAGACGACGUG-5'   (SEQ ID NO: 872)
CKAP5-4417 Target:5'-GGTCAGCAAAGAGACCCTCTGCTGCAC-3' (SEQ ID NO: 1448)

5'-AGCAAAGAGACCCUCUGCUGCACCA-3'     (SEQ ID NO: 2025)
                3'-AGUCGUUUCUCUGGGAGACGACGUGGU-5'   (SEQ ID NO: 873)
CKAP5-4419 Target:5'-TCAGCAAAGAGACCCTCTGCTGCACCA-3' (SEQ ID NO: 1449)

5'-CAAAGAGACCCUCUGCUGCACCAAU-3'     (SEQ ID NO: 2026)
                3'-UCGUUUCUCUGGGAGACGACGUGGUUA-5'   (SEQ ID NO: 874)
CKAP5-4421 Target:5'-AGCAAAGAGACCCTCTGCTGCACCAAT-3' (SEQ ID NO: 1450)

5'-AAGAGACCCUCUGCUGCACCAAUAA-3'     (SEQ ID NO: 2027)
                3'-GUUUCUCUGGGAGACGACGUGGUUAUU-5'   (SEQ ID NO: 875)
CKAP5-4423 Target:5'-CAAAGAGACCCTCTGCTGCACCAATAA-3' (SEQ ID NO: 1451)

5'-UACGCAAGGGACCAGCUGAGGACAU-3'     (SEQ ID NO: 2028)
                3'-CAAUGCGUUCCCUGGUCGACUCCUGUA-5'   (SEQ ID NO: 876)
CKAP5-4505 Target:5'-GTTACGCAAGGGACCAGCTGAGGACAT-3' (SEQ ID NO: 1452)

5'-CGCAAGGGACCAGCUGAGGACAUGU-3'     (SEQ ID NO: 2029)
                3'-AUGCGUUCCCUGGUCGACUCCUGUACA-5'   (SEQ ID NO: 877)
CKAP5-4507 Target:5'-TACGCAAGGGACCAGCTGAGGACATGT-3' (SEQ ID NO: 1453)

5'-CGCCGAGAAUUCCAGCUGGAUCUAG-3'     (SEQ ID NO: 2030)
                3'-AGGCGGCUCUUAAGGUCGACCUAGAUC-5'   (SEQ ID NO: 878)
CKAP5-4591 Target:5'-TCCGCCGAGAATTCCAGCTGGATCTAG-3' (SEQ ID NO: 1454)

5'-CCGAGAAUUCCAGCUGGAUCUAGAU-3'     (SEQ ID NO: 2031)
                3'-GCGGCUCUUAAGGUCGACCUAGAUCUA-5'   (SEQ ID NO: 879)
CKAP5-4593 Target:5'-CGCCGAGAATTCCAGCTGGATCTAGAT-3' (SEQ ID NO: 1455)

5'-AGAUCCGGGCUGUUUCUCCACACUU-3'     (SEQ ID NO: 2032)
                3'-GUUCUAGGCCCGACAAAGAGGUGUGAA-5'   (SEQ ID NO: 880)
CKAP5-4718 Target:5'-CAAGATCCGGGCTGTTTCTCCACACTT-3' (SEQ ID NO: 1456)

5'-AUCCGGGCUGUUUCUCCACACUUCG-3'     (SEQ ID NO: 2033)
                3'-UCUAGGCCCGACAAAGAGGUGUGAAGC-5'   (SEQ ID NO: 881)
CKAP5-4720 Target:5'-AGATCCGGGCTGTTTCTCCACACTTCG-3' (SEQ ID NO: 1457)

5'-GAUGACAUGCACAGUAAUACAGCAU-3'     (SEQ ID NO: 2034)
                3'-AGCUACUGUACGUGUCAUUAUGUCGUA-5'   (SEQ ID NO: 882)
CKAP5-4744 Target:5'-TCGATGACATGCACAGTAATACAGCAT-3' (SEQ ID NO: 1458)

5'-UGACAUGCACAGUAAUACAGCAUCC-3'     (SEQ ID NO: 2035)
                3'-CUACUGUACGUGUCAUUAUGUCGUAGG-5'   (SEQ ID NO: 883)
CKAP5-4746 Target:5'-GATGACATGCACAGTAATACAGCATCC-3' (SEQ ID NO: 1459)
```

TABLE 3-continued

Selected Human Anti-CKAP5 DsiRNAs, Unmodified Duplexes (Asymmetrics)

```
                 5'-ACAUGCACAGUAAUACAGCAUCCAC-3'    (SEQ ID NO: 2036)
                 3'-ACUGUACGUGUCAUUAUGUCGUAGGUG-5'  (SEQ ID NO: 884)
CKAP5-4748 Target:5'-TGACATGCACAGTAATACAGCATCCAC-3' (SEQ ID NO: 1460)

5'-AUGCACAGUAAUACAGCAUCCACAA-3'    (SEQ ID NO: 2037)
                 3'-UGUACGUGUCAUUAUGUCGUAGGUGUU-5'  (SEQ ID NO: 885)
CKAP5-4750 Target:5'-ACATGCACAGTAATACAGCATCCACAA-3' (SEQ ID NO: 1461)

5'-GCACAGUAAUACAGCAUCCACAAUC-3'    (SEQ ID NO: 2038)
                 3'-UACGUGUCAUUAUGUCGUAGGUGUUAG-5'  (SEQ ID NO: 886)
CKAP5-4752 Target:5'-ATGCACAGTAATACAGCATCCACAATC-3' (SEQ ID NO: 1462)

5'-ACAGUAAUACAGCAUCCACAAUCAA-3'    (SEQ ID NO: 2039)
                 3'-CGUGUCAUUAUGUCGUAGGUGUUAGUU-5'  (SEQ ID NO: 887)
CKAP5-4754 Target:5'-GCACAGTAATACAGCATCCACAATCAA-3' (SEQ ID NO: 1463)

5'-AGUAAUACAGCAUCCACAAUCAAUU-3'    (SEQ ID NO: 2040)
                 3'-UGUCAUUAUGUCGUAGGUGUUAGUUAA-5'  (SEQ ID NO: 888)
CKAP5-4756 Target:5'-ACAGTAATACAGCATCCACAATCAATT-3' (SEQ ID NO: 1464)

5'-UAAUACAGCAUCCACAAUCAAUUUC-3'    (SEQ ID NO: 2041)
                 3'-UCAUUAUGUCGUAGGUGUUAGUUAAAG-5'  (SEQ ID NO: 889)
CKAP5-4758 Target:5'-AGTAATACAGCATCCACAATCAATTTC-3' (SEQ ID NO: 1465)

5'-AUACAGCAUCCACAAUCAAUUUCAU-3'    (SEQ ID NO: 2042)
                 3'-AUUAUGUCGUAGGUGUUAGUUAAAGUA-5'  (SEQ ID NO: 890)
CKAP5-4760 Target:5'-TAATACAGCATCCACAATCAATTTCAT-3' (SEQ ID NO: 1466)

5'-ACAGCAUCCACAAUCAAUUUCAUUA-3'    (SEQ ID NO: 2043)
                 3'-UAUGUCGUAGGUGUUAGUUAAAGUAAU-5'  (SEQ ID NO: 891)
CKAP5-4762 Target:5'-ATACAGCATCCACAATCAATTTCATTA-3' (SEQ ID NO: 1467)

5'-AGCAUCCACAAUCAAUUUCAUUAUC-3'    (SEQ ID NO: 2044)
                 3'-UGUCGUAGGUGUUAGUUAAAGUAAUAG-5'  (SEQ ID NO: 892)
CKAP5-4764 Target:5'-ACAGCATCCACAATCAATTTCATTATC-3' (SEQ ID NO: 1468)

5'-CAUCCACAAUCAAUUUCAUUAUCUC-3'    (SEQ ID NO: 2045)
                 3'-UCGUAGGUGUUAGUUAAAGUAAUAGAG-5'  (SEQ ID NO: 893)
CKAP5-4766 Target:5'-AGCATCCACAATCAATTTCATTATCTC-3' (SEQ ID NO: 1469)

5'-UCCACAAUCAAUUUCAUUAUCUCCC-3'    (SEQ ID NO: 2046)
                 3'-GUAGGUGUUAGUUAAAGUAAUAGAGGG-5'  (SEQ ID NO: 894)
CKAP5-4768 Target:5'-CATCCACAATCAATTTCATTATCTCCC-3' (SEQ ID NO: 1470)

5'-CACAAUCAAUUUCAUUAUCUCCCAA-3'    (SEQ ID NO: 2047)
                 3'-AGGUGUUAGUUAAAGUAAUAGAGGGUU-5'  (SEQ ID NO: 895)
CKAP5-4770 Target:5'-TCCACAATCAATTTCATTATCTCCCAA-3' (SEQ ID NO: 1471)

5'-CAAUCAAUUUCAUUAUCUCCCAAGU-3'    (SEQ ID NO: 2048)
                 3'-GUGUUAGUUAAAGUAAUAGAGGGUUCA-5'  (SEQ ID NO: 896)
CKAP5-4772 Target:5'-CACAATCAATTTCATTATCTCCCAAGT-3' (SEQ ID NO: 1472)

5'-AUCAAUUUCAUUAUCUCCCAAGUAG-3'    (SEQ ID NO: 2049)
                 3'-GUUAGUUAAAGUAAUAGAGGGUUCAUC-5'  (SEQ ID NO: 897)
CKAP5-4774 Target:5'-CAATCAATTTCATTATCTCCCAAGTAG-3' (SEQ ID NO: 1473)

5'-CAAUUUCAUUAUCUCCCAAGUAGCC-3'    (SEQ ID NO: 2050)
                 3'-UAGUUAAAGUAAUAGAGGGUUCAUCGG-5'  (SEQ ID NO: 898)
CKAP5-4776 Target:5'-ATCAATTTCATTATCTCCCAAGTAGCC-3' (SEQ ID NO: 1474)

5'-AUUUCAUUAUCUCCCAAGUAGCCAG-3'    (SEQ ID NO: 2051)
                 3'-GUUAAAGUAAUAGAGGGUUCAUCGGUC-5'  (SEQ ID NO: 899)
CKAP5-4778 Target:5'-CAATTTCATTATCTCCCAAGTAGCCAG-3' (SEQ ID NO: 1475)

5'-UUCAUUAUCUCCCAAGUAGCCAGUG-3'    (SEQ ID NO: 2052)
                 3'-UAAAGUAAUAGAGGGUUCAUCGGUCAC-5'  (SEQ ID NO: 900)
CKAP5-4780 Target:5'-ATTTCATTATCTCCCAAGTAGCCAGTG-3' (SEQ ID NO: 1476)

5'-CAUUAUCUCCCAAGUAGCCAGUGGU-3'    (SEQ ID NO: 2053)
                 3'-AAGUAAUAGAGGGUUCAUCGGUCACCA-5'  (SEQ ID NO: 901)
CKAP5-4782 Target:5'-TTCATTATCTCCCAAGTAGCCAGTGGT-3' (SEQ ID NO: 1477)

5'-UUAUCUCCCAAGUAGCCAGUGGUGA-3'    (SEQ ID NO: 2054)
                 3'-GUAAUAGAGGGUUCAUCGGUCACCACU-5'  (SEQ ID NO: 902)
CKAP5-4784 Target:5'-CATTATCTCCCAAGTAGCCAGTGGTGA-3' (SEQ ID NO: 1478)
```

TABLE 3-continued

Selected Human Anti-CKAP5 DsiRNAs, Unmodified Duplexes (Asymmetrics)

```
                5'-AUCUCCCAAGUAGCCAGUGGUGACA-3'     (SEQ ID NO: 2055)
                3'-AAUAGAGGGUUCAUCGGUCACCACUGU-5'   (SEQ ID NO: 903)
CKAP5-4786 Target:5'-TTATCTCCCAAGTAGCCAGTGGTGACA-3' (SEQ ID NO: 1479)

5'-CUCCCAAGUAGCCAGUGGUGACAUC-3'     (SEQ ID NO: 2056)
                3'-UAGAGGGUUCAUCGGUCACCACUGUAG-5'   (SEQ ID NO: 904)
CKAP5-4788 Target:5'-ATCTCCCAAGTAGCCAGTGGTGACATC-3' (SEQ ID NO: 1480)

5'-CCCAAGUAGCCAGUGGUGACAUCAA-3'     (SEQ ID NO: 2057)
                3'-GAGGGUUCAUCGGUCACCACUGUAGUU-5'   (SEQ ID NO: 905)
CKAP5-4790 Target:5'-CTCCCAAGTAGCCAGTGGTGACATCAA-3' (SEQ ID NO: 1481)

5'-CAAGUAGCCAGUGGUGACAUCAACA-3'     (SEQ ID NO: 2058)
                3'-GGGUUCAUCGGUCACCACUGUAGUUGU-5'   (SEQ ID NO: 906)
CKAP5-4792 Target:5'-CCCAAGTAGCCAGTGGTGACATCAACA-3' (SEQ ID NO: 1482)

5'-GCCCGGGAGGCCUCCACUGGAGUAC-3'     (SEQ ID NO: 2059)
                3'-AACGGGCCCUCCGGAGGUGACCUCAUG-5'   (SEQ ID NO: 907)
CKAP5-5041 Target:5'-TTGCCCGGGAGGCCTCCACTGGAGTAC-3' (SEQ ID NO: 1483)

5'-CCGGGAGGCCUCCACUGGAGUACUA-3'     (SEQ ID NO: 2060)
                3'-CGGGCCCUCCGGAGGUGACCUCAUGAU-5'   (SEQ ID NO: 908)
CKAP5-5043 Target:5'-GCCCGGGAGGCCTCCACTGGAGTACTA-3' (SEQ ID NO: 1484)

5'-GGGAGGCCUCCACUGGAGUACUAAA-3'     (SEQ ID NO: 2061)
                3'-GGCCCUCCGGAGGUGACCUCAUGAUUU-5'   (SEQ ID NO: 909)
CKAP5-5045 Target:5'-CCGGGAGGCCTCCACTGGAGTACTAAA-3' (SEQ ID NO: 1485)

5'-GAGGCCUCCACUGGAGUACUAAAAG-3'     (SEQ ID NO: 2062)
                3'-CCCUCCGGAGGUGACCUCAUGAUUUUC-5'   (SEQ ID NO: 910)
CKAP5-5047 Target:5'-GGGAGGCCTCCACTGGAGTACTAAAAG-3' (SEQ ID NO: 1486)

5'-AUCACCUUAAUGCUGGAUUCUCGGA-3'     (SEQ ID NO: 2063)
                3'-AGUAGUGGAAUUACGACCUAAGAGCCU-5'   (SEQ ID NO: 911)
CKAP5-5089 Target:5'-TCATCACCTTAATGCTGGATTCTCGGA-3' (SEQ ID NO: 1487)

5'-CACCUUAAUGCUGGAUUCUCGGAUU-3'     (SEQ ID NO: 2064)
                3'-UAGUGGAAUUACGACCUAAGAGCCUAA-5'   (SEQ ID NO: 912)
CKAP5-5091 Target:5'-ATCACCTTAATGCTGGATTCTCGGATT-3' (SEQ ID NO: 1488)

5'-CCUUAAUGCUGGAUUCUCGGAUUGA-3'     (SEQ ID NO: 2065)
                3'-GUGGAAUUACGACCUAAGAGCCUAACU-5'   (SEQ ID NO: 913)
CKAP5-5093 Target:5'-CACCTTAATGCTGGATTCTCGGATTGA-3' (SEQ ID NO: 1489)

5'-UUAAUGCUGGAUUCUCGGAUUGAAG-3'     (SEQ ID NO: 2066)
                3'-GGAAUUACGACCUAAGAGCCUAACUUC-5'   (SEQ ID NO: 914)
CKAP5-5095 Target:5'-CCTTAATGCTGGATTCTCGGATTGAAG-3' (SEQ ID NO: 1490)

5'-AAUGCUGGAUUCUCGGAUUGAAGAU-3'     (SEQ ID NO: 2067)
                3'-AAUUACGACCUAAGAGCCUAACUUCUA-5'   (SEQ ID NO: 915)
CKAP5-5097 Target:5'-TTAATGCTGGATTCTCGGATTGAAGAT-3' (SEQ ID NO: 1491)

5'-UGCUGGAUUCUCGGAUUGAAGAUCU-3'     (SEQ ID NO: 2068)
                3'-UUACGACCUAAGAGCCUAACUUCUAGA-5'   (SEQ ID NO: 916)
CKAP5-5099 Target:5'-AATGCTGGATTCTCGGATTGAAGATCT-3' (SEQ ID NO: 1492)

5'-CUGGAUUCUCGGAUUGAAGAUCUUG-3'     (SEQ ID NO: 2069)
                3'-ACGACCUAAGAGCCUAACUUCUAGAAC-5'   (SEQ ID NO: 917)
CKAP5-5101 Target:5'-TGCTGGATTCTCGGATTGAAGATCTTG-3' (SEQ ID NO: 1493)

5'-GGAUUCUCGGAUUGAAGAUCUUGAG-3'     (SEQ ID NO: 2070)
                3'-GACCUAAGAGCCUAACUUCUAGAACUC-5'   (SEQ ID NO: 918)
CKAP5-5103 Target:5'-CTGGATTCTCGGATTGAAGATCTTGAG-3' (SEQ ID NO: 1494)

5'-AUUCUCGGAUUGAAGAUCUUGAGGA-3'     (SEQ ID NO: 2071)
                3'-CCUAAGAGCCUAACUUCUAGAACUCCU-5'   (SEQ ID NO: 919)
CKAP5-5105 Target:5'-GGATTCTCGGATTGAAGATCTTGAGGA-3' (SEQ ID NO: 1495)

5'-CUGUGAACCUCUUGGUGGUGAAGGU-3'     (SEQ ID NO: 2072)
                3'-GAGACACUUGGAGAACCACCACUUCCA-5'   (SEQ ID NO: 920)
CKAP5-5150 Target:5'-CTCTGTGAACCTCTTGGTGGTGAAGGT-3' (SEQ ID NO: 1496)

5'-GUGAACCUCUUGGUGGUGAAGGUUC-3'     (SEQ ID NO: 2073)
                3'-GACACUUGGAGAACCACCACUUCCAAG-5'   (SEQ ID NO: 921)
CKAP5-5152 Target:5'-CTGTGAACCTCTTGGTGGTGAAGGTTC-3' (SEQ ID NO: 1497)
```

TABLE 3-continued

Selected Human Anti-CKAP5 DsiRNAs, Unmodified Duplexes (Asymmetrics)

```
                 5'-GAACCUCUUGGUGGUGAAGGUUCUG-3'      (SEQ ID NO: 2074)
                 3'-CACUUGGAGAACCACCACUUCCAAGAC-5'    (SEQ ID NO: 922)
CKAP5-5154 Target:5'-GTGAACCTCTTGGTGGTGAAGGTTCTG-3'   (SEQ ID NO: 1498)

5'-ACCUCUUGGUGGUGAAGGUUCUGGA-3'      (SEQ ID NO: 2075)
                 3'-CUUGGAGAACCACCACUUCCAAGACCU-5'    (SEQ ID NO: 923)
CKAP5-5156 Target:5'-GAACCTCTTGGTGGTGAAGGTTCTGGA-3'   (SEQ ID NO: 1499)

5'-GACAGCCUGCUAGCAACAGCCAGUU-3'      (SEQ ID NO: 2076)
                 3'-UUCUGUCGGACGAUCGUUGUCGGUCAA-5'    (SEQ ID NO: 924)
CKAP5-5230 Target:5'-AAGACAGCCTGCTAGCAACAGCCAGTT-3'   (SEQ ID NO: 1500)

5'-AGUUCUCCCAAAUUCUCAGAGCUUG-3'      (SEQ ID NO: 2077)
                 3'-GGUCAAGAGGGUUUAAGAGUCUCGAAC-5'    (SEQ ID NO: 925)
CKAP5-5251 Target:5'-CCAGTTCTCCCAAATTCTCAGAGCTTG-3'   (SEQ ID NO: 1501)

5'-UUCUCCCAAAUUCUCAGAGCUUGUU-3'      (SEQ ID NO: 2078)
                 3'-UCAAGAGGGUUUAAGAGUCUCGAACAA-5'    (SEQ ID NO: 926)
CKAP5-5253 Target:5'-AGTTCTCCCAAATTCTCAGAGCTTGTT-3'   (SEQ ID NO: 1502)

5'-CUCCCAAAUUCUCAGAGCUUGUUAU-3'      (SEQ ID NO: 2079)
                 3'-AAGAGGGUUUAAGAGUCUCGAACAAUA-5'    (SEQ ID NO: 927)
CKAP5-5255 Target:5'-TTCTCCCAAATTCTCAGAGCTTGTTAT-3'   (SEQ ID NO: 1503)

5'-CCCAAAUUCUCAGAGCUUGUUAUGA-3'      (SEQ ID NO: 2080)
                 3'-GAGGGUUUAAGAGUCUCGAACAAUACU-5'    (SEQ ID NO: 928)
CKAP5-5257 Target:5'-CTCCCAAATTCTCAGAGCTTGTTATGA-3'   (SEQ ID NO: 1504)

5'-CAAAUUCUCAGAGCUUGUUAUGAAG-3'      (SEQ ID NO: 2081)
                 3'-GGGUUUAAGAGUCUCGAACAAUACUUC-5'    (SEQ ID NO: 929)
CKAP5-5259 Target:5'-CCCAAATTCTCAGAGCTTGTTATGAAG-3'   (SEQ ID NO: 1505)

5'-AAUUCUCAGAGCUUGUUAUGAAGUG-3'      (SEQ ID NO: 2082)
                 3'-GUUUAAGAGUCUCGAACAAUACUUCAC-5'    (SEQ ID NO: 930)
CKAP5-5261 Target:5'-CAAATTCTCAGAGCTTGTTATGAAGTG-3'   (SEQ ID NO: 1506)

5'-UUCUCAGAGCUUGUUAUGAAGUGUC-3'      (SEQ ID NO: 2083)
                 3'-UUAAGAGUCUCGAACAAUACUUCACAG-5'    (SEQ ID NO: 931)
CKAP5-5263 Target:5'-AATTCTCAGAGCTTGTTATGAAGTGTC-3'   (SEQ ID NO: 1507)

5'-CUCAGAGCUUGUUAUGAAGUGUCUC-3'      (SEQ ID NO: 2084)
                 3'-AAGAGUCUCGAACAAUACUUCACAGAG-5'    (SEQ ID NO: 932)
CKAP5-5265 Target:5'-TTCTCAGAGCTTGTTATGAAGTGTCTC-3'   (SEQ ID NO: 1508)

5'-CAGAGCUUGUUAUGAAGUGUCUCUG-3'      (SEQ ID NO: 2085)
                 3'-GAGUCUCGAACAAUACUUCACAGAGAC-5'    (SEQ ID NO: 933)
CKAP5-5267 Target:5'-CTCAGAGCTTGTTATGAAGTGTCTCTG-3'   (SEQ ID NO: 1509)

5'-GAGCUUGUUAUGAAGUGUCUCUGGA-3'      (SEQ ID NO: 2086)
                 3'-GUCUCGAACAAUACUUCACAGAGACCU-5'    (SEQ ID NO: 934)
CKAP5-5269 Target:5'-CAGAGCTTGTTATGAAGTGTCTCTGGA-3'   (SEQ ID NO: 1510)

5'-AGCAUUAACCUAGACAGAAUUCUUC-3'      (SEQ ID NO: 2087)
                 3'-UAUCGUAAUUGGAUCUGUCUUAAGAAG-5'    (SEQ ID NO: 935)
CKAP5-5326 Target:5'-ATAGCATTAACCTAGACAGAATTCTTC-3'   (SEQ ID NO: 1511)

5'-CAUUAACCUAGACAGAAUUCUUCUG-3'      (SEQ ID NO: 2088)
                 3'-UCGUAAUUGGAUCUGUCUUAAGAAGAC-5'    (SEQ ID NO: 936)
CKAP5-5328 Target:5'-AGCATTAACCTAGACAGAATTCTTCTG-3'   (SEQ ID NO: 1512)

5'-UUAACCUAGACAGAAUUCUUCUGGA-3'      (SEQ ID NO: 2089)
                 3'-GUAAUUGGAUCUGUCUUAAGAAGACCU-5'    (SEQ ID NO: 937)
CKAP5-5330 Target:5'-CATTAACCTAGACAGAATTCTTCTGGA-3'   (SEQ ID NO: 1513)

5'-AACCUAGACAGAAUUCUUCUGGAUA-3'      (SEQ ID NO: 2090)
                 3'-AAUUGGAUCUGUCUUAAGAAGACCUAU-5'    (SEQ ID NO: 938)
CKAP5-5332 Target:5'-TTAACCTAGACAGAATTCTTCTGGATA-3'   (SEQ ID NO: 1514)

5'-CCUAGACAGAAUUCUUCUGGAUAUC-3'      (SEQ ID NO: 2091)
                 3'-UUGGAUCUGUCUUAAGAAGACCUAUAG-5'    (SEQ ID NO: 939)
CKAP5-5334 Target:5'-AACCTAGACAGAATTCTTCTGGATATC-3'   (SEQ ID NO: 1515)

5'-UAGACAGAAUUCUUCUGGAUAUCCA-3'      (SEQ ID NO: 2092)
                 3'-GGAUCUGUCUUAAGAAGACCUAUAGGU-5'    (SEQ ID NO: 940)
CKAP5-5336 Target:5'-CCTAGACAGAATTCTTCTGGATATCCA-3'   (SEQ ID NO: 1516)
```

TABLE 3-continued

Selected Human Anti-CKAP5 DsiRNAs, Unmodified Duplexes (Asymmetrics)

```
                    5'-UCCACAUUUCAUGAAGGUCUUCCC-3'       (SEQ ID NO: 2093)
                    3'-AUAGGUGUAAAAGUACUUCCAGAAGGG-5'    (SEQ ID NO: 941)
CKAP5-5357 Target: 5'-TATCCACATTTTCATGAAGGTCTTCCC-3'     (SEQ ID NO: 1517)

5'-GAAGCAAUGCAAAAGUGAAUUUCCC-3'      (SEQ ID NO: 2094)
                    3'-GACUUCGUUACGUUUUCACUUAAAGGG-5'    (SEQ ID NO: 942)
CKAP5-5394 Target: 5'-CTGAAGCAATGCAAAAGTGAATTTCCC-3'     (SEQ ID NO: 1518)

5'-AGCAAUGCAAAAGUGAAUUUCCCAU-3'      (SEQ ID NO: 2095)
                    3'-CUUCGUUACGUUUUCACUUAAAGGGUA-5'    (SEQ ID NO: 943)
CKAP5-5396 Target: 5'-GAAGCAATGCAAAAGTGAATTTCCCAT-3'     (SEQ ID NO: 1519)

5'-CAAUGCAAAAGUGAAUUUCCCAUAA-3'      (SEQ ID NO: 2096)
                    3'-UCGUUACGUUUUCACUUAAAGGGUAUU-5'    (SEQ ID NO: 944)
CKAP5-5398 Target: 5'-AGCAATGCAAAAGTGAATTTCCCATAA-3'     (SEQ ID NO: 1520)

5'-AGUAUGGACCAGACUGGGAGCAAGU-3'      (SEQ ID NO: 2097)
                    3'-UGUCAUACCUGGUCUGACCCUCGUUCA-5'    (SEQ ID NO: 945)
CKAP5-5551 Target: 5'-ACAGTATGGACCAGACTGGGAGCAAGT-3'     (SEQ ID NO: 1521)

5'-UAUGGACCAGACUGGGAGCAAGUCU-3'      (SEQ ID NO: 2098)
                    3'-UCAUACCUGGUCUGACCCUCGUUCAGA-5'    (SEQ ID NO: 946)
CKAP5-5553 Target: 5'-AGTATGGACCAGACTGGGAGCAAGTCT-3'     (SEQ ID NO: 1522)

5'-UGGACCAGACUGGGAGCAAGUCUGA-3'      (SEQ ID NO: 2099)
                    3'-AUACCUGGUCUGACCCUCGUUCAGACU-5'    (SEQ ID NO: 947)
CKAP5-5555 Target: 5'-TATGGACCAGACTGGGAGCAAGTCTGA-3'     (SEQ ID NO: 1523)

5'-GACCAGACUGGGAGCAAGUCUGAUA-3'      (SEQ ID NO: 2100)
                    3'-ACCUGGUCUGACCCUCGUUCAGACUAU-5'    (SEQ ID NO: 948)
CKAP5-5557 Target: 5'-TGGACCAGACTGGGAGCAAGTCTGATA-3'     (SEQ ID NO: 1524)

5'-CCAGACUGGGAGCAAGUCUGAUAAG-3'      (SEQ ID NO: 2101)
                    3'-CUGGUCUGACCCUCGUUCAGACUAUUC-5'    (SEQ ID NO: 949)
CKAP5-5559 Target: 5'-GACCAGACTGGGAGCAAGTCTGATAAG-3'     (SEQ ID NO: 1525)

5'-AGACUGGGAGCAAGUCUGAUAAGGA-3'      (SEQ ID NO: 2102)
                    3'-GGUCUGACCCUCGUUCAGACUAUUCCU-5'    (SEQ ID NO: 950)
CKAP5-5561 Target: 5'-CCAGACTGGGAGCAAGTCTGATAAGGA-3'     (SEQ ID NO: 1526)

5'-ACUGGGAGCAAGUCUGAUAAGGAAA-3'      (SEQ ID NO: 2103)
                    3'-UCUGACCCUCGUUCAGACUAUUCCUUU-5'    (SEQ ID NO: 951)
CKAP5-5563 Target: 5'-AGACTGGGAGCAAGTCTGATAAGGAAA-3'     (SEQ ID NO: 1527)

5'-UGGGAGCAAGUCUGAUAAGGAAACA-3'      (SEQ ID NO: 2104)
                    3'-UGACCCUCGUUCAGACUAUUCCUUUGU-5'    (SEQ ID NO: 952)
CKAP5-5565 Target: 5'-ACTGGGAGCAAGTCTGATAAGGAAACA-3'     (SEQ ID NO: 1528)

5'-GGAGCAAGUCUGAUAAGGAAACAGA-3'      (SEQ ID NO: 2105)
                    3'-ACCCUCGUUCAGACUAUUCCUUUGUCU-5'    (SEQ ID NO: 953)
CKAP5-5567 Target: 5'-TGGGAGCAAGTCTGATAAGGAAACAGA-3'     (SEQ ID NO: 1529)

5'-AGCAAGUCUGAUAAGGAAACAGAAA-3'      (SEQ ID NO: 2106)
                    3'-CCUCGUUCAGACUAUUCCUUUGUCUUU-5'    (SEQ ID NO: 954)
CKAP5-5569 Target: 5'-GGAGCAAGTCTGATAAGGAAACAGAAA-3'     (SEQ ID NO: 1530)

5'-CAAGUCUGAUAAGGAAACAGAAAAG-3'      (SEQ ID NO: 2107)
                    3'-UCGUUCAGACUAUUCCUUUGUCUUUUC-5'    (SEQ ID NO: 955)
CKAP5-5571 Target: 5'-AGCAAGTCTGATAAGGAAACAGAAAAG-3'     (SEQ ID NO: 1531)

5'-AGUCUGAUAAGGAAACAGAAAAGGG-3'      (SEQ ID NO: 2108)
                    3'-GUUCAGACUAUUCCUUUGUCUUUUCCC-5'    (SEQ ID NO: 956)
CKAP5-5573 Target: 5'-CAAGTCTGATAAGGAAACAGAAAAGGG-3'     (SEQ ID NO: 1532)

5'-UCUGAUAAGGAAACAGAAAAGGGAG-3'      (SEQ ID NO: 2109)
                    3'-UCAGACUAUUCCUUUGUCUUUUCCCUC-5'    (SEQ ID NO: 957)
CKAP5-5575 Target: 5'-AGTCTGATAAGGAAACAGAAAAGGGAG-3'     (SEQ ID NO: 1533)

5'-UGAUAAGGAAACAGAAAAGGGAGCA-3'      (SEQ ID NO: 2110)
                    3'-AGACUAUUCCUUUGUCUUUUCCCUCGU-5'    (SEQ ID NO: 958)
CKAP5-5577 Target: 5'-TCTGATAAGGAAACAGAAAAGGGAGCA-3'     (SEQ ID NO: 1534)

5'-AUAAGGAAACAGAAAAGGGAGCAUC-3'      (SEQ ID NO: 2111)
                    3'-ACUAUUCCUUUGUCUUUUCCCUCGUAG-5'    (SEQ ID NO: 959)
CKAP5-5579 Target: 5'-TGATAAGGAAACAGAAAAGGGAGCATC-3'     (SEQ ID NO: 1535)
```

TABLE 3-continued

Selected Human Anti-CKAP5 DsiRNAs, Unmodified Duplexes (Asymmetrics)

|  |  |  |
|---|---|---|
| | 5'-AAGGAAACAGAAAAGGGAGCAUCUC-3' | (SEQ ID NO: 2112) |
| | 3'-UAUUCCUUUGUCUUUUCCCUCGUAGAG-5' | (SEQ ID NO: 960) |
| CKAP5-5581 Target: | 5'-ATAAGGAAACAGAAAAGGGAGCATCTC-3' | (SEQ ID NO: 1536) |
| | 5'-UCUCGAAUAGAUGAAAAAUCAUCAA-3' | (SEQ ID NO: 2113) |
| | 3'-GUAGAGCUUAUCUACUUUUUAGUAGUU-5' | (SEQ ID NO: 961) |
| CKAP5-5602 Target: | 5'-CATCTCGAATAGATGAAAAATCATCAA-3' | (SEQ ID NO: 1537) |
| | 5'-UCGAAUAGAUGAAAAAUCAUCAAAG-3' | (SEQ ID NO: 2114) |
| | 3'-AGAGCUUAUCUACUUUUUAGUAGUUUC-5' | (SEQ ID NO: 962) |
| CKAP5-5604 Target: | 5'-TCTCGAATAGATGAAAAATCATCAAAG-3' | (SEQ ID NO: 1538) |
| | 5'-GAAUAGAUGAAAAAUCAUCAAAGGC-3' | (SEQ ID NO: 2115) |
| | 3'-AGCUUAUCUACUUUUUAGUAGUUUCCG-5' | (SEQ ID NO: 963) |
| CKAP5-5606 Target: | 5'-TCGAATAGATGAAAAATCATCAAAGGC-3' | (SEQ ID NO: 1539) |
| | 5'-AUAGAUGAAAAAUCAUCAAAGGCCA-3' | (SEQ ID NO: 2116) |
| | 3'-CUUAUCUACUUUUUAGUAGUUUCCGGU-5' | (SEQ ID NO: 964) |
| CKAP5-5608 Target: | 5'-GAATAGATGAAAAATCATCAAAGGCCA-3' | (SEQ ID NO: 1540) |
| | 5'-AGAUGAAAAAUCAUCAAAGGCCAAA-3' | (SEQ ID NO: 2117) |
| | 3'-UAUCUACUUUUUAGUAGUUUCCGGUUU-5' | (SEQ ID NO: 965) |
| CKAP5-5610 Target: | 5'-ATAGATGAAAAATCATCAAAGGCCAAA-3' | (SEQ ID NO: 1541) |
| | 5'-AUGAAAAAUCAUCAAAGGCCAAAGU-3' | (SEQ ID NO: 2118) |
| | 3'-UCUACUUUUUAGUAGUUUCCGGUUUCA-5' | (SEQ ID NO: 966) |
| CKAP5-5612 Target: | 5'-AGATGAAAAATCATCAAAGGCCAAAGT-3' | (SEQ ID NO: 1542) |
| | 5'-GAAAAAUCAUCAAAGGCCAAAGUGA-3' | (SEQ ID NO: 2119) |
| | 3'-UACUUUUUAGUAGUUUCCGGUUUCACU-5' | (SEQ ID NO: 967) |
| CKAP5-5614 Target: | 5'-ATGAAAAATCATCAAAGGCCAAAGTGA-3' | (SEQ ID NO: 1543) |
| | 5'-AAAAUCAUCAAAGGCCAAAGUGAAU-3' | (SEQ ID NO: 2120) |
| | 3'-CUUUUUAGUAGUUUCCGGUUUCACUUA-5' | (SEQ ID NO: 968) |
| CKAP5-5616 Target: | 5'-GAAAAATCATCAAAGGCCAAAGTGAAT-3' | (SEQ ID NO: 1544) |
| | 5'-AAUCAUCAAAGGCCAAAGUGAAUGA-3' | (SEQ ID NO: 2121) |
| | 3'-UUUUAGUAGUUUCCGGUUUCACUUACU-5' | (SEQ ID NO: 969) |
| CKAP5-5618 Target: | 5'-AAAATCATCAAAGGCCAAAGTGAATGA-3' | (SEQ ID NO: 1545) |
| | 5'-AUGAUUUCUUAGCUGAGAUUUUUAA-3' | (SEQ ID NO: 2122) |
| | 3'-CUUACUAAAGAAUCGACUCUAAAAAUU-5' | (SEQ ID NO: 970) |
| CKAP5-5639 Target: | 5'-GAATGATTTCTTAGCTGAGATTTTTAA-3' | (SEQ ID NO: 1546) |
| | 5'-GAUUUCUUAGCUGAGAUUUUUAAGA-3' | (SEQ ID NO: 2123) |
| | 3'-UACUAAAGAAUCGACUCUAAAAAUUCU-5' | (SEQ ID NO: 971) |
| CKAP5-5641 Target: | 5'-ATGATTTCTTAGCTGAGATTTTTAAGA-3' | (SEQ ID NO: 1547) |
| | 5'-UUUCUUAGCUGAGAUUUUUAAGAAG-3' | (SEQ ID NO: 2124) |
| | 3'-CUAAAGAAUCGACUCUAAAAAUUCUUC-5' | (SEQ ID NO: 972) |
| CKAP5-5643 Target: | 5'-GATTTCTTAGCTGAGATTTTTAAGAAG-3' | (SEQ ID NO: 1548) |
| | 5'-UCUUAGCUGAGAUUUUUAAGAAGAU-3' | (SEQ ID NO: 2125) |
| | 3'-AAAGAAUCGACUCUAAAAAUUCUUCUA-5' | (SEQ ID NO: 973) |
| CKAP5-5645 Target: | 5'-TTTCTTAGCTGAGATTTTTAAGAAGAT-3' | (SEQ ID NO: 1549) |
| | 5'-UUAGCUGAGAUUUUUAAGAAGAUUG-3' | (SEQ ID NO: 2126) |
| | 3'-AGAAUCGACUCUAAAAAUUCUUCUAAC-5' | (SEQ ID NO: 974) |
| CKAP5-5647 Target: | 5'-TCTTAGCTGAGATTTTTAAGAAGATTG-3' | (SEQ ID NO: 1550) |
| | 5'-AGCUGAGAUUUUUAAGAAGAUUGGC-3' | (SEQ ID NO: 2127) |
| | 3'-AAUCGACUCUAAAAAUUCUUCUAACCG-5' | (SEQ ID NO: 975) |
| CKAP5-5649 Target: | 5'-TTAGCTGAGATTTTTAAGAAGATTGGC-3' | (SEQ ID NO: 1551) |
| | 5'-CUGAGAUUUUUAAGAAGAUUGGCUC-3' | (SEQ ID NO: 2128) |
| | 3'-UCGACUCUAAAAAUUCUUCUAACCGAG-5' | (SEQ ID NO: 976) |
| CKAP5-5651 Target: | 5'-AGCTGAGATTTTTAAGAAGATTGGCTC-3' | (SEQ ID NO: 1552) |
| | 5'-GAGAUUUUUAAGAAGAUUGGCUCUA-3' | (SEQ ID NO: 2129) |
| | 3'-GACUCUAAAAAUUCUUCUAACCGAGAU-5' | (SEQ ID NO: 977) |
| CKAP5-5653 Target: | 5'-CTGAGATTTTTAAGAAGATTGGCTCTA-3' | (SEQ ID NO: 1553) |
| | 5'-GAUUUUUAAGAAGAUUGGCUCUAAA-3' | (SEQ ID NO: 2130) |
| | 3'-CUCUAAAAAUUCUUCUAACCGAGAUUU-5' | (SEQ ID NO: 978) |
| CKAP5-5655 Target: | 5'-GAGATTTTTAAGAAGATTGGCTCTAAA-3' | (SEQ ID NO: 1554) |

TABLE 3-continued

Selected Human Anti-CKAP5 DsiRNAs, Unmodified Duplexes (Asymmetrics)

```
                5'-UUUUUAAGAAGAUUGGCUCUAAAGA-3'     (SEQ ID NO: 2131)
                3'-CUAAAAAUUCUUCUAACCGAGAUUUCU-5'   (SEQ ID NO: 979)
CKAP5-5657 Target:5'-GATTTTTAAGAAGATTGGCTCTAAAGA-3' (SEQ ID NO: 1555)

5'-UAGCAGAGUUAUAUGAAUAUAAGAA-3'     (SEQ ID NO: 2132)
                3'-UGAUCGUCUCAAUAUACUUAUAUUCUU-5'   (SEQ ID NO: 980)
CKAP5-5699 Target:5'-ACTAGCAGAGTTATATGAATATAAGAA-3' (SEQ ID NO: 1556)

5'-GCAGAGUUAUAUGAAUAUAAGAAGA-3'     (SEQ ID NO: 2133)
                3'-AUCGUCUCAAUAUACUUAUAUUCUUCU-5'   (SEQ ID NO: 981)
CKAP5-5701 Target:5'-TAGCAGAGTTATATGAATATAAGAAGA-3' (SEQ ID NO: 1557)

5'-AGAGUUAUAUGAAUAUAAGAAGAAA-3'     (SEQ ID NO: 2134)
                3'-CGUCUCAAUAUACUUAUAUUCUUCUUU-5'   (SEQ ID NO: 982)
CKAP5-5703 Target:5'-GCAGAGTTATATGAATATAAGAAGAAA-3' (SEQ ID NO: 1558)

5'-AGUUAUAUGAAUAUAAGAAGAAAUA-3'     (SEQ ID NO: 2135)
                3'-UCUCAAUAUACUUAUAUUCUUCUUUAU-5'   (SEQ ID NO: 983)
CKAP5-5705 Target:5'-AGAGTTATATGAATATAAGAAGAAATA-3' (SEQ ID NO: 1559)

5'-UUAUAUGAAUAUAAGAAGAAAUACU-3'     (SEQ ID NO: 2136)
                3'-UCAAUAUACUUAUAUUCUUCUUUAUGA-5'   (SEQ ID NO: 984)
CKAP5-5707 Target:5'-AGTTATATGAATATAAGAAGAAATACT-3' (SEQ ID NO: 1560)

5'-AUAUGAAUAUAAGAAGAAAUACUCA-3'     (SEQ ID NO: 2137)
                3'-AAUAUACUUAUAUUCUUCUUUAUGAGU-5'   (SEQ ID NO: 985)
CKAP5-5709 Target:5'-TTATATGAATATAAGAAGAAATACTCA-3' (SEQ ID NO: 1561)

5'-AUGAAUAUAAGAAGAAAUACUCAGA-3'     (SEQ ID NO: 2138)
                3'-UAUACUUAUAUUCUUCUUUAUGAGUCU-5'   (SEQ ID NO: 986)
CKAP5-5711 Target:5'-ATATGAATATAAGAAGAAATACTCAGA-3' (SEQ ID NO: 1562)

5'-UGACAUUGAACCAUUUCUGAAAAAU-3'     (SEQ ID NO: 2139)
                3'-CGACUGUAACUUGGUAAAGACUUUUUA-5'   (SEQ ID NO: 987)
CKAP5-5739 Target:5'-GCTGACATTGAACCATTTCTGAAAAAT-3' (SEQ ID NO: 1563)

5'-ACAUUGAACCAUUUCUGAAAAAUUC-3'     (SEQ ID NO: 2140)
                3'-ACUGUAACUUGGUAAAGACUUUUUAAG-5'   (SEQ ID NO: 988)
CKAP5-5741 Target:5'-TGACATTGAACCATTTCTGAAAAATTC-3' (SEQ ID NO: 1564)

5'-AUUGAACCAUUUCUGAAAAAUUCCU-3'     (SEQ ID NO: 2141)
                3'-UGUAACUUGGUAAAGACUUUUUAAGGA-5'   (SEQ ID NO: 989)
CKAP5-5743 Target:5'-ACATTGAACCATTTCTGAAAAATTCCT-3' (SEQ ID NO: 1565)

5'-UGAACCAUUUCUGAAAAAUUCCUCA-3'     (SEQ ID NO: 2142)
                3'-UAACUUGGUAAAGACUUUUUAAGGAGU-5'   (SEQ ID NO: 990)
CKAP5-5745 Target:5'-ATTGAACCATTTCTGAAAAATTCCTCA-3' (SEQ ID NO: 1566)

5'-AACCAUUUCUGAAAAAUUCCUCACA-3'     (SEQ ID NO: 2143)
                3'-ACUUGGUAAAGACUUUUUAAGGAGUGU-5'   (SEQ ID NO: 991)
CKAP5-5747 Target:5'-TGAACCATTTCTGAAAAATTCCTCACA-3' (SEQ ID NO: 1567)

5'-CCAUUUCUGAAAAAUUCCUCACAGU-3'     (SEQ ID NO: 2144)
                3'-UUGGUAAAGACUUUUUAAGGAGUGUCA-5'   (SEQ ID NO: 992)
CKAP5-5749 Target:5'-AACCATTTCTGAAAAATTCCTCACAGT-3' (SEQ ID NO: 1568)

5'-AGAGGCCUUCGGGUGAUUGAGAUGG-3'     (SEQ ID NO: 2145)
                3'-UUUCUCCGGAAGCCCACUAACUCUACC-5'   (SEQ ID NO: 993)
CKAP5-5794 Target:5'-AAAGAGGCCTTCGGGTGATTGAGATGG-3' (SEQ ID NO: 1569)

5'-AGGCCUUCGGGUGAUUGAGAUGGAG-3'     (SEQ ID NO: 2146)
                3'-UCUCCGGAAGCCCACUAACUCUACCUC-5'   (SEQ ID NO: 994)
CKAP5-5796 Target:5'-AGAGGCCTTCGGGTGATTGAGATGGAG-3' (SEQ ID NO: 1570)

5'-GCCUUCGGGUGAUUGAGAUGGAGAG-3'     (SEQ ID NO: 2147)
                3'-UCCGGAAGCCCACUAACUCUACCUCUC-5'   (SEQ ID NO: 995)
CKAP5-5798 Target:5'-AGGCCTTCGGGTGATTGAGATGGAGAG-3' (SEQ ID NO: 1571)

5'-CUUCGGGUGAUUGAGAUGGAGAGGG-3'     (SEQ ID NO: 2148)
                3'-CGGAAGCCCACUAACUCUACCUCUCCC-5'   (SEQ ID NO: 996)
CKAP5-5800 Target:5'-GCCTTCGGGTGATTGAGATGGAGAGGG-3' (SEQ ID NO: 1572)

5'-UCGGGUGAUUGAGAUGGAGAGGGAG-3'     (SEQ ID NO: 2149)
                3'-GAAGCCCACUAACUCUACCUCUCCCUC-5'   (SEQ ID NO: 997)
CKAP5-5802 Target:5'-CTTCGGGTGATTGAGATGGAGAGGGAG-3' (SEQ ID NO: 1573)
```

TABLE 3-continued

Selected Human Anti-CKAP5 DsiRNAs, Unmodified Duplexes (Asymmetrics)

```
                 5'-GGGUGAUUGAGAUGGAGAGGGAGGG-3'    (SEQ ID NO: 2150)
                 3'-AGCCCACUAACUCUACCUCUCCCUCCC-5'  (SEQ ID NO: 998)
CKAP5-5804 Target:5'-TCGGGTGATTGAGATGGAGAGGGAGGG-3' (SEQ ID NO: 1574)

5'-CCAUCUGUCUACUUGGAAAGGCUAA-3'    (SEQ ID NO: 2151)
                 3'-CCGGUAGACAGAUGAACCUUUCCGAUU-5'  (SEQ ID NO: 999)
CKAP5-5944 Target:5'-GGCCATCTGTCTACTTGGAAAGGCTAA-3' (SEQ ID NO: 1575)

5'-AUCUGUCUACUUGGAAAGGCUAAAG-3'    (SEQ ID NO: 2152)
                 3'-GGUAGACAGAUGAACCUUUCCGAUUUC-5'  (SEQ ID NO: 1000)
CKAP5-5946 Target:5'-CCATCTGTCTACTTGGAAAGGCTAAAG-3' (SEQ ID NO: 1576)

5'-CUGUCUACUUGGAAAGGCUAAAGAU-3'    (SEQ ID NO: 2153)
                 3'-UAGACAGAUGAACCUUUCCGAUUUCUA-5'  (SEQ ID NO: 1001)
CKAP5-5948 Target:5'-ATCTGTCTACTTGGAAAGGCTAAAGAT-3' (SEQ ID NO: 1577)

5'-GUCUACUUGGAAAGGCUAAAGAUCC-3'    (SEQ ID NO: 2154)
                 3'-GACAGAUGAACCUUUCCGAUUUCUAGG-5'  (SEQ ID NO: 1002)
CKAP5-5950 Target:5'-CTGTCTACTTGGAAAGGCTAAAGATCC-3' (SEQ ID NO: 1578)

5'-UGACCUCUUUGCUCUCCAAACCAGC-3'    (SEQ ID NO: 2155)
                 3'-AAACUGGAGAAACGAGAGGUUUGGUCG-5'  (SEQ ID NO: 1003)
CKAP5-6026 Target:5'-TTTGACCTCTTTGCTCTCCAAACCAGC-3' (SEQ ID NO: 1579)

5'-ACCUCUUUGCUCUCCAAACCAGCAG-3'    (SEQ ID NO: 2156)
                 3'-ACUGGAGAAACGAGAGGUUUGGUCGUC-5'  (SEQ ID NO: 1004)
CKAP5-6028 Target:5'-TGACCTCTTTGCTCTCCAAACCAGCAG-3' (SEQ ID NO: 1580)

5'-CUCUUUGCUCUCCAAACCAGCAGUU-3'    (SEQ ID NO: 2157)
                 3'-UGGAGAAACGAGAGGUUUGGUCGUCAA-5'  (SEQ ID NO: 1005)
CKAP5-6030 Target:5'-ACCTCTTTGCTCTCCAAACCAGCAGTT-3' (SEQ ID NO: 1581)

5'-CUUUGCUCUCCAAACCAGCAGUUCC-3'    (SEQ ID NO: 2158)
                 3'-GAGAAACGAGAGGUUUGGUCGUCAAGG-5'  (SEQ ID NO: 1006)
CKAP5-6032 Target:5'-CTCTTTGCTCTCCAAACCAGCAGTTCC-3' (SEQ ID NO: 1582)

5'-UGACCUCCUCCUCCUCCACAGCUAA-3'    (SEQ ID NO: 2159)
                 3'-ACACUGGAGGAGGAGGAGGUGUCGAUU-5'  (SEQ ID NO: 1007)
CKAP5-6173 Target:5'-TGTGACCTCCTCCTCCTCCACAGCTAA-3' (SEQ ID NO: 1583)

5'-AGACUGGAGAGAAUAAAGAGCAGUC-3'    (SEQ ID NO: 2160)
                 3'-UUUCUGACCUCUCUUAUUUCUCGUCAG-5'  (SEQ ID NO: 1008)
CKAP5-6217 Target:5'-AAAGACTGGAGAGAATAAAGAGCAGTC-3' (SEQ ID NO: 1584)

5'-ACUGGAGAGAAUAAAGAGCAGUCGC-3'    (SEQ ID NO: 2161)
                 3'-UCUGACCUCUCUUAUUUCUCGUCAGCG-5'  (SEQ ID NO: 1009)
CKAP5-6219 Target:5'-AGACTGGAGAGAATAAAGAGCAGTCGC-3' (SEQ ID NO: 1585)

5'-UGGAGAGAAUAAAGAGCAGUCGCAA-3'    (SEQ ID NO: 2162)
                 3'-UGACCUCUCUUAUUUCUCGUCAGCGUU-5'  (SEQ ID NO: 1010)
CKAP5-6221 Target:5'-ACTGGAGAGAATAAAGAGCAGTCGCAA-3' (SEQ ID NO: 1586)

5'-GAGAGAAUAAAGAGCAGUCGCAAAU-3'    (SEQ ID NO: 2163)
                 3'-ACCUCUCUUAUUUCUCGUCAGCGUUUA-5'  (SEQ ID NO: 1011)
CKAP5-6223 Target:5'-TGGAGAGAATAAAGAGCAGTCGCAAAT-3' (SEQ ID NO: 1587)

5'-GAGAAUAAAGAGCAGUCGCAAAUGA-3'    (SEQ ID NO: 2164)
                 3'-CUCUCUUAUUUCUCGUCAGCGUUUACU-5'  (SEQ ID NO: 1012)
CKAP5-6225 Target:5'-GAGAGAATAAAGAGCAGTCGCAAATGA-3' (SEQ ID NO: 1588)

5'-GAAUAAAGAGCAGUCGCAAAUGAAG-3'    (SEQ ID NO: 2165)
                 3'-CUCUUAUUUCUCGUCAGCGUUUACUUC-5'  (SEQ ID NO: 1013)
CKAP5-6227 Target:5'-GAGAATAAAGAGCAGTCGCAAATGAAG-3' (SEQ ID NO: 1589)

5'-AUAAAGAGCAGUCGCAAAUGAAGCU-3'    (SEQ ID NO: 2166)
                 3'-CUUAUUUCUCGUCAGCGUUUACUUCGA-5'  (SEQ ID NO: 1014)
CKAP5-6229 Target:5'-GAATAAAGAGCAGTCGCAAATGAAGCT-3' (SEQ ID NO: 1590)

5'-AAAGAGCAGUCGCAAAUGAAGCUGC-3'    (SEQ ID NO: 2167)
                 3'-UAUUUCUCGUCAGCGUUUACUUCGACG-5'  (SEQ ID NO: 1015)
CKAP5-6231 Target:5'-ATAAAGAGCAGTCGCAAATGAAGCTGC-3' (SEQ ID NO: 1591)

5'-AGAGCAGUCGCAAAUGAAGCUGCCC-3'    (SEQ ID NO: 2168)
                 3'-UUUCUCGUCAGCGUUUACUUCGACGGG-5'  (SEQ ID NO: 1016)
CKAP5-6233 Target:5'-AAAGAGCAGTCGCAAATGAAGCTGCCC-3' (SEQ ID NO: 1592)
```

TABLE 3-continued

Selected Human Anti-CKAP5 DsiRNAs, Unmodified Duplexes (Asymmetrics)

```
                 5'-AAACUGGUUGUAUGUAUCAUGCCGU-3'    (SEQ ID NO: 2169)
                 3'-UGUUUGACCAACAUACAUAGUACGGCA-5'  (SEQ ID NO: 1017)
CKAP5-6342 Target:5'-ACAAACTGGTTGTATGTATCATGCCGT-3' (SEQ ID NO: 1593)

5'-CUCAUUUGUAAAAUUGUCCUAAUCU-3'    (SEQ ID NO: 2170)
                 3'-ACGAGUAAACAUUUUAACAGGAUUAGA-5'  (SEQ ID NO: 1018)
CKAP5-6544 Target:5'-TGCTCATTTGTAAAATTGTCCTAATCT-3' (SEQ ID NO: 1594)

5'-CAUUUGUAAAAUUGUCCUAAUCUUU-3'    (SEQ ID NO: 2171)
                 3'-GAGUAAACAUUUUAACAGGAUUAGAAA-5'  (SEQ ID NO: 1019)
CKAP5-6546 Target:5'-CTCATTTGTAAAATTGTCCTAATCTTT-3' (SEQ ID NO: 1595)

5'-UUUGUAAAAUUGUCCUAAUCUUUCC-3'    (SEQ ID NO: 2172)
                 3'-GUAAACAUUUUAACAGGAUUAGAAAGG-5'  (SEQ ID NO: 1020)
CKAP5-6548 Target:5'-CATTTGTAAAATTGTCCTAATCTTTCC-3' (SEQ ID NO: 1596)

5'-ACUGUAUUCUGUAUGAAUGCAUGGC-3'    (SEQ ID NO: 2173)
                 3'-AGUGACAUAAGACAUACUUACGUACCG-5'  (SEQ ID NO: 1021)
CKAP5-6656 Target:5'-TCACTGTATTCTGTATGAATGCATGGC-3' (SEQ ID NO: 1597)

5'-UGUAUUCUGUAUGAAUGCAUGGCAU-3'    (SEQ ID NO: 2174)
                 3'-UGACAUAAGACAUACUUACGUACCGUA-5'  (SEQ ID NO: 1022)
CKAP5-6658 Target:5'-ACTGTATTCTGTATGAATGCATGGCAT-3' (SEQ ID NO: 1598)

5'-UAUUCUGUAUGAAUGCAUGGCAUGA-3'    (SEQ ID NO: 2175)
                 3'-ACAUAAGACAUACUUACGUACCGUACU-5'  (SEQ ID NO: 1023)
CKAP5-6660 Target:5'-TGTATTCTGTATGAATGCATGGCATGA-3' (SEQ ID NO: 1599)

5'-UUCUGUAUGAAUGCAUGGCAUGAUA-3'    (SEQ ID NO: 2176)
                 3'-AUAAGACAUACUUACGUACCGUACUAU-5'  (SEQ ID NO: 1024)
CKAP5-6662 Target:5'-TATTCTGTATGAATGCATGGCATGATA-3' (SEQ ID NO: 1600)

5'-CUGUAUGAAUGCAUGGCAUGAUACA-3'    (SEQ ID NO: 2177)
                 3'-AAGACAUACUUACGUACCGUACUAUGU-5'  (SEQ ID NO: 1025)
CKAP5-6664 Target:5'-TTCTGTATGAATGCATGGCATGATACA-3' (SEQ ID NO: 1601)

5'-GUAUGAAUGCAUGGCAUGAUACAAC-3'    (SEQ ID NO: 2178)
                 3'-GACAUACUUACGUACCGUACUAUGUUG-5'  (SEQ ID NO: 1026)
CKAP5-6666 Target:5'-CTGTATGAATGCATGGCATGATACAAC-3' (SEQ ID NO: 1602)

5'-UUUUAUAAAUAAAGUUUGCAUUAAC-3'    (SEQ ID NO: 2179)
                 3'-AGAAAAUAUUUAUUUCAAACGUAAUUG-5'  (SEQ ID NO: 1027)
CKAP5-6704 Target:5'-TCTTTTATAAATAAAGTTTGCATTAAC-3' (SEQ ID NO: 1603)

5'-UUAUAAAUAAAGUUUGCAUUAACUA-3'    (SEQ ID NO: 2180)
                 3'-AAAAUAUUUAUUUCAAACGUAAUUGAU-5'  (SEQ ID NO: 1028)
CKAP5-6706 Target:5'-TTTTATAAATAAAGTTTGCATTAACTA-3' (SEQ ID NO: 1604)

5'-AUAAAUAAAGUUUGCAUUAACUAUA-3'    (SEQ ID NO: 2181)
                 3'-AAUAUUUAUUUCAAACGUAAUUGAUAU-5'  (SEQ ID NO: 1029)
CKAP5-6708 Target:5'-TTATAAATAAAGTTTGCATTAACTATA-3' (SEQ ID NO: 1605)

5'-AAAUAAAGUUUGCAUUAACUAUACC-3'    (SEQ ID NO: 2182)
                 3'-UAUUUAUUUCAAACGUAAUUGAUAUGG-5'  (SEQ ID NO: 1030)
CKAP5-6710 Target:5'-ATAAATAAAGTTTGCATTAACTATACC-3' (SEQ ID NO: 1606)

5'-AUAAAGUUUGCAUUAACUAUACCUG-3'    (SEQ ID NO: 2183)
                 3'-UUUUAUUUCAAACGUAAUUGAUAUGGAC-5' (SEQ ID NO: 1031)
CKAP5-6712 Target:5'-AAATAAAGTTTGCATTAACTATACCTG-3' (SEQ ID NO: 1607)

5'-AAAGUUUGCAUUAACUAUACCUGAC-3'    (SEQ ID NO: 2184)
                 3'-UAUUUCAAACGUAAUUGAUAUGGACUG-5'  (SEQ ID NO: 1032)
CKAP5-6714 Target:5'-ATAAAGTTTGCATTAACTATACCTGAC-3' (SEQ ID NO: 1608)

5'-CAGCUGAGGAAAUACUCUUAAUUCU-3'    (SEQ ID NO: 2185)
                 3'-GGGUCGACUCCUUUAUGAGAAUUAAGA-5'  (SEQ ID NO: 1033)
CKAP5-106  Target:5'-CCCAGCTGAGGAAATACTCTTAATTCT-3' (SEQ ID NO: 1609)

5'-UUGAAACUGCCAGUUGAUCAGAAAU-3'    (SEQ ID NO: 2186)
                 3'-CCAACUUUGACGGUCAACUAGUCUUUA-5'  (SEQ ID NO: 1034)
CKAP5-172  Target:5'-GGTTGAAACTGCCAGTTGATCAGAAAT-3' (SEQ ID NO: 1610)

5'-GCCAGUUGAUCAGAAAUGUGAACAC-3'    (SEQ ID NO: 2187)
                 3'-GACGGUCAACUAGUCUUUACACUUGUG-5'  (SEQ ID NO: 1035)
CKAP5-180  Target:5'-CTGCCAGTTGATCAGAAATGTGAACAC-3' (SEQ ID NO: 1611)
```

TABLE 3-continued

Selected Human Anti-CKAP5 DsiRNAs, Unmodified Duplexes (Asymmetrics)

|  |  |  |  |
|---|---|---|---|
| CKAP5-213 | Target: | 5'-GAAAGCAAGGUUAAGUGGGUAUGAA-3'<br>3'-ACCUUUCGUUCCAAUUCACCCAUACUU-5'<br>5'-TGGAAAGCAAGGTTAAGTGGGTATGAA-3' | (SEQ ID NO: 2188)<br>(SEQ ID NO: 1036)<br>(SEQ ID NO: 1612) |
| CKAP5-281 | Target: | 5'-CAGAGUGGUCCAAAUUUUUAGGAUU-3'<br>3'-GGGUCUCACCAGGUUUAAAAAUCCUAA-5'<br>5'-CCCAGAGTGGTCCAAATTTTTAGGATT-3' | (SEQ ID NO: 2189)<br>(SEQ ID NO: 1037)<br>(SEQ ID NO: 1613) |
| CKAP5-337 | Target: | 5'-GUGGUUCAAUUGAAAGGAUUAGAAG-3'<br>3'-GUCACCAAGUUAACUUUCCUAAUCUUC-5'<br>5'-CAGTGGTTCAATTGAAAGGATTAGAAG-3' | (SEQ ID NO: 2190)<br>(SEQ ID NO: 1038)<br>(SEQ ID NO: 1614) |
| CKAP5-353 | Target: | 5'-GAUUAGAAGCUGCACUUGUUUAUGU-3'<br>3'-UCCUAAUCUUCGACGUGAACAAAUACA-5'<br>5'-AGGATTAGAAGCTGCACTTGTTTATGT-3' | (SEQ ID NO: 2191)<br>(SEQ ID NO: 1039)<br>(SEQ ID NO: 1615) |
| CKAP5-362 | Target: | 5'-CUGCACUUGUUUAUGUUGAAAAUGC-3'<br>3'-UCGACGUGAACAAAUACAACUUUUACG-5'<br>5'-AGCTGCACTTGTTTATGTTGAAAATGC-3' | (SEQ ID NO: 2192)<br>(SEQ ID NO: 1040)<br>(SEQ ID NO: 1616) |
| CKAP5-395 | Target: | 5'-CAGGAAAAACCACAGGAGAAGUUGU-3'<br>3'-UCGUCCUUUUUGGUGUCCUCUUCAACA-5'<br>5'-AGCAGGAAAAACCACAGGAGAAGTTGT-3' | (SEQ ID NO: 2193)<br>(SEQ ID NO: 1041)<br>(SEQ ID NO: 1617) |
| CKAP5-422 | Target: | 5'-CAGGUGUUGUAAGUAAGGUGUUCAA-3'<br>3'-CAGUCCACAACAUUCAUUCCACAAGUU-5'<br>5'-GTCAGGTGTTGTAAGTAAGGTGTTCAA-3' | (SEQ ID NO: 2194)<br>(SEQ ID NO: 1042)<br>(SEQ ID NO: 1618) |
| CKAP5-427 | Target: | 5'-GUUGUAAGUAAGGUGUUCAAUCAAC-3'<br>3'-CACAACAUUCAUUCCACAAGUUAGUUG-5'<br>5'-GTGTTGTAAGTAAGGTGTTCAATCAAC-3' | (SEQ ID NO: 2195)<br>(SEQ ID NO: 1043)<br>(SEQ ID NO: 1619) |
| CKAP5-443 | Target: | 5'-UCAAUCAACCUAAAGCUAAAGCCAA-3'<br>3'-CAAGUUAGUUGGAUUUCGAUUUCGGUU-5'<br>5'-GTTCAATCAACCTAAAGCTAAAGCCAA-3' | (SEQ ID NO: 2196)<br>(SEQ ID NO: 1044)<br>(SEQ ID NO: 1620) |
| CKAP5-537 | Target: | 5'-CCUGAAAGGCUUGGACAAUAAGAAU-3'<br>3'-GAGGACUUUCCGAACCUGUUAUUCUUA-5'<br>5'-CTCCTGAAAGGCTTGGACAATAAGAAT-3' | (SEQ ID NO: 2197)<br>(SEQ ID NO: 1045)<br>(SEQ ID NO: 1621) |
| CKAP5-637 | Target: | 5'-AAGCCAAUUAUCAAAGUGUUGCCAA-3'<br>3'-AAUUCGGUUAAUAGUUUCACAACGGUU-5'<br>5'-TTAAGCCAATTATCAAAGTGTTGCCAA-3' | (SEQ ID NO: 2198)<br>(SEQ ID NO: 1046)<br>(SEQ ID NO: 1622) |
| CKAP5-649 | Target: | 5'-AAAGUGUUGCCAAAACUCUUUGAGU-3'<br>3'-AGUUUCACAACGGUUUUGAGAAACUCA-5'<br>5'-TCAAAGTGTTGCCAAAACTCTTTGAGT-3' | (SEQ ID NO: 2199)<br>(SEQ ID NO: 1047)<br>(SEQ ID NO: 1623) |
| CKAP5-659 | Target: | 5'-CAAAACUCUUUGAGUCUCGAGAGAA-3'<br>3'-CGGUUUUGAGAAACUCAGAGCUCUCUU-5'<br>5'-GCCAAAACTCTTTGAGTCTCGAGAGAA-3' | (SEQ ID NO: 2200)<br>(SEQ ID NO: 1048)<br>(SEQ ID NO: 1624) |
| CKAP5-686 | Target: | 5'-CUGUUCGAGAUGAAGCCAAACUAAU-3'<br>3'-CCGACAAGCUCUACUUCGGUUUGAUUA-5'<br>5'-GGCTGTTCGAGATGAAGCCAAACTAAT-3' | (SEQ ID NO: 2201)<br>(SEQ ID NO: 1049)<br>(SEQ ID NO: 1625) |
| CKAP5-755 | Target: | 5'-CAUUACAAAAUAUAAACUCUGUUCA-3'<br>3'-GGGUAAUGUUUUAUAUUUGAGACAAGU-5'<br>5'-CCCATTACAAAATATAAACTCTGTTCA-3' | (SEQ ID NO: 2202)<br>(SEQ ID NO: 1050)<br>(SEQ ID NO: 1626) |
| CKAP5-761 | Target: | 5'-AAAAUAUAAACUCUGUUCAGUUGAA-3'<br>3'-UGUUUUAUAUUUGAGACAAGUCAACUU-5'<br>5'-ACAAAATATAAACTCTGTTCAGTTGAA-3' | (SEQ ID NO: 2203)<br>(SEQ ID NO: 1051)<br>(SEQ ID NO: 1627) |
| CKAP5-766 | Target: | 5'-AUAAACUCUGUUCAGUUGAAAGAAC-3'<br>3'-UAUAUUUGAGACAAGUCAACUUUCUUG-5'<br>5'-ATATAAACTCTGTTCAGTTGAAAGAAC-3' | (SEQ ID NO: 2204)<br>(SEQ ID NO: 1052)<br>(SEQ ID NO: 1628) |
| CKAP5-773 | Target: | 5'-CUGUUCAGUUGAAAGAACUAGAAGA-3'<br>3'-GAGACAAGUCAACUUUCUUGAUCUUCU-5'<br>5'-CTCTGTTCAGTTGAAAGAACTAGAAGA-3' | (SEQ ID NO: 2205)<br>(SEQ ID NO: 1053)<br>(SEQ ID NO: 1629) |
| CKAP5-928 | Target: | 5'-GAUGAGGUGCCACAAAUAGAUGCUU-3'<br>3'-CACUACUCCACGGUGUUUAUCUACGAA-5'<br>5'-GTGATGAGGTGCCACAAATAGATGCTT-3' | (SEQ ID NO: 2206)<br>(SEQ ID NO: 1054)<br>(SEQ ID NO: 1630) |

TABLE 3-continued

Selected Human Anti-CKAP5 DsiRNAs, Unmodified Duplexes (Asymmetrics)

```
                5'-AAAUAGAUGCUUAUGAGCUUUUAGA-3'     (SEQ ID NO: 2207)
                3'-UGUUUAUCUACGAAUACUCGAAAAUCU-5'   (SEQ ID NO: 1055)
CKAP5-941 Target: 5'-ACAAATAGATGCTTATGAGCTTTTAGA-3'  (SEQ ID NO: 1631)

5'-AUGAGCUUUUAGAAGCUGUAGAAAU-3'     (SEQ ID NO: 2208)
                3'-AAUACUCGAAAAUCUUCGACAUCUUUA-5'   (SEQ ID NO: 1056)
CKAP5-953 Target: 5'-TTATGAGCTTTTAGAAGCTGTAGAAAT-3'  (SEQ ID NO: 1632)

5'-CCCUGGAGUCUGUAGAAGUACUAAU-3'     (SEQ ID NO: 2209)
                3'-CCGGGACCUCAGACAUCUUCAUGAUUA-5'   (SEQ ID NO: 1057)
CKAP5-1046 Target: 5'-GGCCCTGGAGTCTGTAGAAGTACTAAT-3' (SEQ ID NO: 1633)

5'-GAGUCUGUAGAAGUACUAAUAAAAA-3'     (SEQ ID NO: 2210)
                3'-ACCUCAGACAUCUUCAUGAUUAUUUU-5'    (SEQ ID NO: 1058)
CKAP5-1051 Target: 5'-TGGAGTCTGTAGAAGTACTAATAAAAA-3' (SEQ ID NO: 1634)

5'-CAGAUUUAGUAAAAGCAUUAAAGAA-3'     (SEQ ID NO: 2211)
                3'-ACGUCUAAAUCAUUUUCGUAAUUUCUU-5'   (SEQ ID NO: 1059)
CKAP5-1103 Target: 5'-TGCAGATTTAGTAAAAGCATTAAAGAA-3' (SEQ ID NO: 1635)

5'-AAAAGCAUUAAAGAAGGUUGUUGGA-3'     (SEQ ID NO: 2212)
                3'-CAUUUUCGUAAUUUCUUCCAACAACCU-5'   (SEQ ID NO: 1060)
CKAP5-1113 Target: 5'-GTAAAAGCATTAAAGAAGGTTGTTGGA-3' (SEQ ID NO: 1636)

5'-CAUUAAAGAAGGUUGUUGGAAAGGA-3'     (SEQ ID NO: 2213)
                3'-UCGUAAUUUCUUCCAACAACCUUUCCU-5'   (SEQ ID NO: 1061)
CKAP5-1118 Target: 5'-AGCATTAAAGAAGGTTGTTGGAAAGGA-3' (SEQ ID NO: 1637)

5'-GAAGGUUGUUGGAAAGGACACCAAU-3'     (SEQ ID NO: 2214)
                3'-UUCUUCCAACAACCUUUCCUGUGGUUA-5'   (SEQ ID NO: 1062)
CKAP5-1125 Target: 5'-AAGAAGGTTGTTGGAAAGGACACCAAT-3' (SEQ ID NO: 1638)

5'-GGAAGAAAUUUGGACAAUAUGCAGG-3'     (SEQ ID NO: 2215)
                3'-UUCCUUCUUUAAACCUGUUAUACGUCC-5'   (SEQ ID NO: 1063)
CKAP5-1205 Target: 5'-AAGGAAGAAATTTGGACAATATGCAGG-3' (SEQ ID NO: 1639)

5'-GUGAGGAUGUUUUAGCAGUAAUGGA-3'     (SEQ ID NO: 2216)
                3'-GUCACUCCUACAAAAUCGUCAUUACCU-5'   (SEQ ID NO: 1064)
CKAP5-1343 Target: 5'-CAGTGAGGATGTTTTAGCAGTAATGGA-3' (SEQ ID NO: 1640)

5'-GUUUUAGCAGUAAUGGAUAAUAAAA-3'     (SEQ ID NO: 2217)
                3'-UACAAAAUCGUCAUUACCUAUUAUUUU-5'   (SEQ ID NO: 1065)
CKAP5-1351 Target: 5'-ATGTTTTAGCAGTAATGGATAATAAAA-3' (SEQ ID NO: 1641)

5'-CAAGCAGCAGACAUCUCUUUUUAUU-3'     (SEQ ID NO: 2218)
                3'-UAGUUCGUCGUCUGUAGAGAAAAAUAA-5'   (SEQ ID NO: 1066)
CKAP5-1386 Target: 5'-ATCAAGCAGCAGACATCTCTTTTTATT-3' (SEQ ID NO: 1642)

5'-GACAUCUCUUUUUAUUGCAAGAAGU-3'     (SEQ ID NO: 2219)
                3'-GUCUGUAGAGAAAAAUAACGUUCUUCA-5'   (SEQ ID NO: 1067)
CKAP5-1395 Target: 5'-CAGACATCTCTTTTTATTGCAAGAAGT-3' (SEQ ID NO: 1643)

5'-UCAGAGAUGCCGCAUUUGAAGCAUU-3'     (SEQ ID NO: 2220)
                3'-UCAGUCUCUACGGCGUAAACUUCGUAA-5'   (SEQ ID NO: 1068)
CKAP5-1514 Target: 5'-AGTCAGAGATGCCGCATTTGAAGCATT-3' (SEQ ID NO: 1644)

5'-CAUUGGGUACUGCUUUGAAGGUGGU-3'     (SEQ ID NO: 2221)
                3'-UCGUAACCCAUGACGAAACUUCCACCA-5'   (SEQ ID NO: 1069)
CKAP5-1535 Target: 5'-AGCATTGGGTACTGCTTTGAAGGTGGT-3' (SEQ ID NO: 1645)

5'-GUGGACAAACUCAAGCUUGAUAAGA-3'     (SEQ ID NO: 2222)
                3'-UACACCUGUUUGAGUUCGAACUAUUCU-5'   (SEQ ID NO: 1070)
CKAP5-1594 Target: 5'-ATGTGGACAAACTCAAGCTTGATAAGA-3' (SEQ ID NO: 1646)

5'-AAGAAUGUUCAGAAAGGUAGAACU-3'      (SEQ ID NO: 2223)
                3'-GUUUCUUACAAGUCUUUUCCAUCUUGA-5'   (SEQ ID NO: 1071)
CKAP5-1622 Target: 5'-CAAAGAATGTTCAGAAAAGGTAGAACT-3' (SEQ ID NO: 1647)

5'-UCAGAAAAGGUAGAACUGAUACAUG-3'     (SEQ ID NO: 2224)
                3'-CAAGUCUUUUCCAUCUUGACUAUGUAC-5'   (SEQ ID NO: 1072)
CKAP5-1630 Target: 5'-GTTCAGAAAAGGTAGAACTGATACATG-3' (SEQ ID NO: 1648)

5'-GGUAGAACUGAUACAUGGUAAGAAA-3'     (SEQ ID NO: 2225)
                3'-UUCCAUCUUGACUAUGUACCAUUCUUU-5'   (SEQ ID NO: 1073)
CKAP5-1638 Target: 5'-AAGGTAGAACTGATACATGGTAAGAAA-3' (SEQ ID NO: 1649)
```

TABLE 3-continued

Selected Human Anti-CKAP5 DsiRNAs, Unmodified Duplexes (Asymmetrics)

```
                5'-CAGGGAAUACUGGAACCAAGAACAA-3'      (SEQ ID NO: 2226)
                3'-GCGUCCCUUAUGACCUUGGUUCUUGUU-5'    (SEQ ID NO: 1074)
CKAP5-1847 Target:5'-CGCAGGGAATACTGGAACCAAGAACAA-3'  (SEQ ID NO: 1650)

5'-CCUGAGCUCUCGAUAGAAGUAUGUG-3'      (SEQ ID NO: 2227)
                3'-UCGGACUCGAGAGCUAUCUUCAUACAC-5'    (SEQ ID NO: 1075)
CKAP5-1903 Target:5'-AGCCTGAGCTCTCGATAGAAGTATGTG-3'  (SEQ ID NO: 1651)

5'-CGAUAGAAGUAUGUGAAGAAAAAGC-3'      (SEQ ID NO: 2228)
                3'-GAGCUAUCUUCAUACACUUCUUUUUCG-5'    (SEQ ID NO: 1076)
CKAP5-1913 Target:5'-CTCGATAGAAGTATGTGAAGAAAAAGC-3'  (SEQ ID NO: 1652)

5'-CUUGACAGCAGUAACUGGAAAGAAA-3'      (SEQ ID NO: 2229)
                3'-AAGAACUGUCGUCAUUGACCUUUCUUU-5'    (SEQ ID NO: 1077)
CKAP5-1972 Target:5'-TTCTTGACAGCAGTAACTGGAAAGAAA-3'  (SEQ ID NO: 1653)

5'-GCUAAUGGACCGAACUGAAAUGCCA-3'      (SEQ ID NO: 2230)
                3'-CUCGAUUACCUGGCUUGACUUUACGGU-5'    (SEQ ID NO: 1078)
CKAP5-2034 Target:5'-GAGCTAATGGACCGAACTGAAATGCCA-3'  (SEQ ID NO: 1654)

5'-UUAGUGAGGAUGCUAGCCAAGAAAC-3'      (SEQ ID NO: 2231)
                3'-GUAAUCACUCCUACGAUCGGUUCUUUG-5'    (SEQ ID NO: 1079)
CKAP5-2068 Target:5'-CATTAGTGAGGATGCTAGCCAAGAAAC-3'  (SEQ ID NO: 1655)

5'-GCCAAGAAACCUGGAUGGAAAGAAA-3'      (SEQ ID NO: 2232)
                3'-AUCGGUUCUUUGGACCUACCUUUCUUU-5'    (SEQ ID NO: 1080)
CKAP5-2083 Target:5'-TAGCCAAGAAACCTGGATGGAAAGAAA-3'  (SEQ ID NO: 1656)

5'-GAAACCUGGAUGGAAAGAAACUAAU-3'      (SEQ ID NO: 2233)
                3'-UUCUUUGGACCUACCUUUCUUUGAUUA-5'    (SEQ ID NO: 1081)
CKAP5-2088 Target:5'-AAGAAACCTGGATGGAAAGAAACTAAT-3'  (SEQ ID NO: 1657)

5'-GUGAUGCAAAUGAAGCUUCAUAUAG-3'      (SEQ ID NO: 2234)
                3'-UCCACUACGUUUACUUCGAAGUAUAUC-5'    (SEQ ID NO: 1082)
CKAP5-2119 Target:5'-AGGTGATGCAAATGAAGCTTCATATAG-3'  (SEQ ID NO: 1658)

5'-AAACGUCAGCUCAGGUUGUAUUAGA-3'      (SEQ ID NO: 2235)
                3'-GUUUUGCAGUCGAGUCCAACAUAAUCU-5'    (SEQ ID NO: 1083)
CKAP5-2177 Target:5'-CAAAACGTCAGCTCAGGTTGTATTAGA-3'  (SEQ ID NO: 1659)

5'-CAAAAGAAGCUAUGACAGCAAUAGC-3'      (SEQ ID NO: 2236)
                3'-ACGUUUUCUUCGAUACUGUCGUUAUCG-5'    (SEQ ID NO: 1084)
CKAP5-2246 Target:5'-TGCAAAAGAAGCTATGACAGCAATAGC-3'  (SEQ ID NO: 1660)

5'-CAGCAAUAGCCGAAGCCUGUAUGUU-3'      (SEQ ID NO: 2237)
                3'-CUGUCGUUAUCGGCUUCGGACAUACAA-5'    (SEQ ID NO: 1085)
CKAP5-2261 Target:5'-GACAGCAATAGCCGAAGCCTGTATGTT-3'  (SEQ ID NO: 1661)

5'-GAAGCCUGUAUGUUACCAUGGACUG-3'      (SEQ ID NO: 2238)
                3'-GGCUUCGGACAUACAAUGGUACCUGAC-5'    (SEQ ID NO: 1086)
CKAP5-2272 Target:5'-CCGAAGCCTGTATGTTACCATGGACTG-3'  (SEQ ID NO: 1662)

5'-AAAAUCAGUCAGAAACUCUGAAUUG-3'      (SEQ ID NO: 2239)
                3'-GUUUUUAGUCAGUCUUUGAGACUUAAC-5'    (SEQ ID NO: 1087)
CKAP5-2339 Target:5'-CAAAAATCAGTCAGAAACTCTGAATTG-3'  (SEQ ID NO: 1663)

5'-AGCUUUCAUUAGCAAUGUGAAGACA-3'      (SEQ ID NO: 2240)
                3'-UUUCGAAAGUAAUCGUUACACUUCUGU-5'    (SEQ ID NO: 1088)
CKAP5-2412 Target:5'-AAAGCTTTCATTAGCAATGTGAAGACA-3'  (SEQ ID NO: 1664)

5'-GAGAAGAUGCAGGGACAAAGUCCAC-3'      (SEQ ID NO: 2241)
                3'-AACUCUUCUACGUCCCUGUUUCAGGUG-5'    (SEQ ID NO: 1089)
CKAP5-2578 Target:5'-TTGAGAAGATGCAGGGACAAAGTCCAC-3'  (SEQ ID NO: 1665)

5'-GCAAUGAUGUCGUUGAUCUUUUGCC-3'      (SEQ ID NO: 2242)
                3'-CUCGUUACUACAGCAACUAGAAAACGG-5'    (SEQ ID NO: 1090)
CKAP5-2684 Target:5'-GAGCAATGATGTCGTTGATCTTTTGCC-3'  (SEQ ID NO: 1666)

5'-GAAGUGGCAGGUAUUAUUAAUGACG-3'      (SEQ ID NO: 2243)
                3'-UACUUCACCGUCCAUAAUAAUUACUGC-5'    (SEQ ID NO: 1091)
CKAP5-2797 Target:5'-ATGAAGTGGCAGGTATTATTAATGACG-3'  (SEQ ID NO: 1667)

5'-GCCUUGAAGGGUCGACUCAAUGAUU-3'      (SEQ ID NO: 2244)
                3'-GACGGAACUUCCCAGCUGAGUUACUAA-5'    (SEQ ID NO: 1092)
CKAP5-2860 Target:5'-CTGCCTTGAAGGGTCGACTCAATGATT-3'  (SEQ ID NO: 1668)
```

TABLE 3-continued

Selected Human Anti-CKAP5 DsiRNAs, Unmodified Duplexes (Asymmetrics)

```
                  5'-GAAGGGUCGACUCAAUGAUUCAAAU-3'    (SEQ ID NO: 2245)
                  3'-AACUUCCCAGCUGAGUUACUAAGUUUA-5'  (SEQ ID NO: 1093)
CKAP5-2865 Target:5'-TTGAAGGGTCGACTCAATGATTCAAAT-3'  (SEQ ID NO: 1669)

5'-GACUCAAUGAUUCAAAUAAAAUCUU-3'    (SEQ ID NO: 2246)
                  3'-AGCUGAGUUACUAAGUUUAUUUUAGAA-5'  (SEQ ID NO: 1094)
CKAP5-2873 Target:5'-TCGACTCAATGATTCAAATAAAATCTT-3'  (SEQ ID NO: 1670)

5'-AUGAUUCAAAUAAAAUCUUGGUACA-3'    (SEQ ID NO: 2247)
                  3'-GUUACUAAGUUUAUUUUAGAACCAUGU-5'  (SEQ ID NO: 1095)
CKAP5-2879 Target:5'-CAATGATTCAAATAAAATCTTGGTACA-3'  (SEQ ID NO: 1671)

5'-AGCCAUGGGCCCAAAUAUUAAGCAA-3'    (SEQ ID NO: 2248)
                  3'-CAUCGGUACCCGGGUUUAUAAUUCGUU-5'  (SEQ ID NO: 1096)
CKAP5-2937 Target:5'-GTAGCCATGGGCCCAAATATTAAGCAA-3'  (SEQ ID NO: 1672)

5'-AAAUAUUAAGCAACAUGUAAAAAAU-3'    (SEQ ID NO: 2249)
                  3'-GGUUUAUAAUUCGUUGUACAUUUUUUA-5'  (SEQ ID NO: 1097)
CKAP5-2949 Target:5'-CCAAATATTAAGCAACATGTAAAAAAT-3'  (SEQ ID NO: 1673)

5'-CCUUGGAGACAGCAAGAACAAUGUU-3'    (SEQ ID NO: 2250)
                  3'-CAGGAACCUCUGUCGUUCUUGUUACAA-5'  (SEQ ID NO: 1098)
CKAP5-2997 Target:5'-GTCCTTGGAGACAGCAAGAACAATGTT-3'  (SEQ ID NO: 1674)

5'-GAGACAGCAAGAACAAUGUUCGAGC-3'    (SEQ ID NO: 2251)
                  3'-ACCUCUGUCGUUCUUGUUACAAGCUCG-5'  (SEQ ID NO: 1099)
CKAP5-3002 Target:5'-TGGAGACAGCAAGAACAATGTTCGAGC-3'  (SEQ ID NO: 1675)

5'-CAUGAUGCAUUUAGGAUAUGAAAAA-3'    (SEQ ID NO: 2252)
                  3'-AAGUACUACGUAAAUCCUAUACUUUUU-5'  (SEQ ID NO: 1100)
CKAP5-3285 Target:5'-TTCATGATGCATTTAGGATATGAAAAA-3'  (SEQ ID NO: 1676)

5'-CUAGAGAAAGCCAAAGUUAACAUGC-3'    (SEQ ID NO: 2253)
                  3'-ACGAUCUCUUUCGGUUUCAAUUGUACG-5'  (SEQ ID NO: 1101)
CKAP5-3367 Target:5'-TGCTAGAGAAAGCCAAAGTTAACATGC-3'  (SEQ ID NO: 1677)

5'-GGGAAGAAGAUGCCAAGCAAAACCA-3'    (SEQ ID NO: 2254)
                  3'-UUCCCUUCUUCUACGGUUCGUUUUGGU-5'  (SEQ ID NO: 1102)
CKAP5-3571 Target:5'-AAGGGAAGAAGATGCCAAGCAAAACCA-3'  (SEQ ID NO: 1678)

5'-GAAAAGAGCAAAGGAUGAAAGAUGA-3'    (SEQ ID NO: 2255)
                  3'-ACCUUUUCUCGUUUCCUACUUUCUACU-5'  (SEQ ID NO: 1103)
CKAP5-3650 Target:5'-TGGAAAAGAGCAAAGGATGAAAGATGA-3'  (SEQ ID NO: 1679)

5'-GAGCAAAGGAUGAAAGAUGAAAAAG-3'    (SEQ ID NO: 2256)
                  3'-UUCUCGUUUCCUACUUUCUACUUUUUC-5'  (SEQ ID NO: 1104)
CKAP5-3655 Target:5'-AAGAGCAAAGGATGAAAGATGAAAAAG-3'  (SEQ ID NO: 1680)

5'-GGGAUGAAUACAUUGAGCAACUAAA-3'    (SEQ ID NO: 2257)
                  3'-UGCCCUACUUAUGUAACUCGUUGAUUU-5'  (SEQ ID NO: 1105)
CKAP5-3716 Target:5'-ACGGGATGAATACATTGAGCAACTAAA-3'  (SEQ ID NO: 1681)

5'-GAAUACAUUGAGCAACUAAAGACUC-3'    (SEQ ID NO: 2258)
                  3'-UACUUAUGUAACUCGUUGAUUUCUGAG-5'  (SEQ ID NO: 1106)
CKAP5-3721 Target:5'-ATGAATACATTGAGCAACTAAAGACTC-3'  (SEQ ID NO: 1682)

5'-AGUGGCUUACCCUGAGGUUUUUUGA-3'    (SEQ ID NO: 2259)
                  3'-UUUCACCGAAUGGGACUCCAAAAAACU-5'  (SEQ ID NO: 1107)
CKAP5-3890 Target:5'-AAAGTGGCTTACCCTGAGGTTTTTGA-3'   (SEQ ID NO: 1683)

5'-CCUGAGGUUUUUUGACACCAAUACA-3'    (SEQ ID NO: 2260)
                  3'-UGGGACUCCAAAAAACUGUGGUUAUGU-5'  (SEQ ID NO: 1108)
CKAP5-3900 Target:5'-ACCCTGAGGTTTTTTGACACCAATACA-3'  (SEQ ID NO: 1684)

5'-CAAUACAAGCGUCCUGAUGAAAGCA-3'    (SEQ ID NO: 2261)
                  3'-UGGUUAUGUUCGCAGGACUACUUUCGU-5'  (SEQ ID NO: 1109)
CKAP5-3918 Target:5'-ACCAATACAAGCGTCCTGATGAAAGCA-3'  (SEQ ID NO: 1685)

5'-GUCCUGAUGAAAGCACUAGAAUAUU-3'    (SEQ ID NO: 2262)
                  3'-CGCAGGACUACUUUCGUGAUCUUAUAA-5'  (SEQ ID NO: 1110)
CKAP5-3928 Target:5'-GCGTCCTGATGAAAGCACTAGAATATT-3'  (SEQ ID NO: 1686)

5'-AUGAAAGCACUAGAAUAUUUAAAAU-3'    (SEQ ID NO: 2263)
                  3'-ACUACUUUCGUGAUCUUAUAAAUUUUA-5'  (SEQ ID NO: 1111)
CKAP5-3934 Target:5'-TGATGAAAGCACTAGAATATTTAAAT-3'   (SEQ ID NO: 1687)
```

TABLE 3-continued

Selected Human Anti-CKAP5 DsiRNAs, Unmodified Duplexes (Asymmetrics)

```
                5'-GAAAUCUUUCUGAAAAGGAUAUGAG-3'   (SEQ ID NO: 2264)
                3'-ACCUUUAGAAAGACUUUUCCUAUACUC-5' (SEQ ID NO: 1112)
CKAP5-4367 Target: 5'-TGGAAATCTTTCTGAAAAGGATATGAG-3' (SEQ ID NO: 1688)

5'-GAAAAGGAUAUGAGCAUGCUCGAGG-3'   (SEQ ID NO: 2265)
                3'-GACUUUUCCUAUACUCGUACGAGCUCC-5' (SEQ ID NO: 1113)
CKAP5-4378 Target: 5'-CTGAAAAGGATATGAGCATGCTCGAGG-3' (SEQ ID NO: 1689)

5'-GCUCCAAUGCCAACAUGUUACGCAA-3'   (SEQ ID NO: 2266)
                3'-UUCGAGGUUACGGUUGUACAAUGCGUU-5' (SEQ ID NO: 1114)
CKAP5-4487 Target: 5'-AAGCTCCAATGCCAACATGTTACGCAA-3' (SEQ ID NO: 1690)

5'-AAUGCCAACAUGUUACGCAAGGGAC-3'   (SEQ ID NO: 2267)
                3'-GGUUACGGUUGUACAAUGCGUUCCCUG-5' (SEQ ID NO: 1115)
CKAP5-4492 Target: 5'-CCAATGCCAACATGTTACGCAAGGGAC-3' (SEQ ID NO: 1691)

5'-GUGAAAUGCCAGAACUUGUUCAGCA-3'   (SEQ ID NO: 2268)
                3'-UACACUUUACGGUCUUGAACAAGUCGU-5' (SEQ ID NO: 1116)
CKAP5-4649 Target: 5'-ATGTGAAATGCCAGAACTTGTTCAGCA-3' (SEQ ID NO: 1692)

5'-CAGAACUUGUUCAGCACAAACUGGA-3'   (SEQ ID NO: 2269)
                3'-CGGUCUUGAACAAGUCGUGUUUGACCU-5' (SEQ ID NO: 1117)
CKAP5-4658 Target: 5'-GCCAGAACTTGTTCAGCACAAACTGGA-3' (SEQ ID NO: 1693)

5'-ACAAACUGGAUGACAUUUUUGAGCC-3'   (SEQ ID NO: 2270)
                3'-CGUGUUUGACCUACUGUAAAAACUCGG-5' (SEQ ID NO: 1118)
CKAP5-4673 Target: 5'-GCACAAACTGGATGACATTTTTGAGCC-3' (SEQ ID NO: 1694)

5'-GAUGACAUUUUUGAGCCAGUCCUUA-3'   (SEQ ID NO: 2271)
                3'-ACCUACUGUAAAAACUCGGUCAGGAAU-5' (SEQ ID NO: 1119)
CKAP5-4681 Target: 5'-TGGATGACATTTTTGAGCCAGTCCTTA-3' (SEQ ID NO: 1695)

5'-CAUUUUUGAGCCAGUCCUUAUUCCU-3'   (SEQ ID NO: 2272)
                3'-CUGUAAAAACUCGGUCAGGAAUAAGGA-5' (SEQ ID NO: 1120)
CKAP5-4686 Target: 5'-GACATTTTTGAGCCAGTCCTTATTCCT-3' (SEQ ID NO: 1696)

5'-GAGCCAGUCCUUAUUCCUGAACCCA-3'   (SEQ ID NO: 2273)
                3'-AACUCGGUCAGGAAUAAGGACUUGGGU-5' (SEQ ID NO: 1121)
CKAP5-4693 Target: 5'-TTGAGCCAGTCCTTATTCCTGAACCCA-3' (SEQ ID NO: 1697)

5'-CUGGAGUACUAAAAGACCUAAUGCA-3'   (SEQ ID NO: 2274)
                3'-GUGACCUCAUGAUUUUCUGGAUUACGU-5' (SEQ ID NO: 1122)
CKAP5-5057 Target: 5'-CACTGGAGTACTAAAAGACCTAATGCA-3' (SEQ ID NO: 1698)

5'-GUGAAGGUUCUGGAGAAGUCAGACC-3'   (SEQ ID NO: 2275)
                3'-ACCACUUCCAAGACCUCUUCAGUCUGG-5' (SEQ ID NO: 1123)
CKAP5-5167 Target: 5'-TGGTGAAGGTTCTGGAGAAGTCAGACC-3' (SEQ ID NO: 1699)

5'-CCUGAGUGCCCUACUUGUUUUGCUC-3'   (SEQ ID NO: 2276)
                3'-UAGGACUCACGGGAUGAACAAAACGAG-5' (SEQ ID NO: 1124)
CKAP5-5202 Target: 5'-ATCCTGAGTGCCCTACTTGTTTTGCTC-3' (SEQ ID NO: 1700)

5'-CAGCCAGUUCUCCCAAAUUCUCAGA-3'   (SEQ ID NO: 2277)
                3'-UUGUCGGUCAAGAGGGUUUAAGAGUCU-5' (SEQ ID NO: 1125)
CKAP5-5246 Target: 5'-AACAGCCAGTTCTCCCAAATTCTCAGA-3' (SEQ ID NO: 1701)

5'-GCUUGUUAUGAAGUGUCUCUGGAGA-3'   (SEQ ID NO: 2278)
                3'-CUCGAACAAUACUUCACAGAGACCUCU-5' (SEQ ID NO: 1126)
CKAP5-5271 Target: 5'-GAGCTTGTTATGAAGTGTCTCTGGAGA-3' (SEQ ID NO: 1702)

5'-CGACUGUUGCCUGAUACCAUCAAUA-3'   (SEQ ID NO: 2279)
                3'-AAGCUGACAACGGACUAUGGUAGUUAU-5' (SEQ ID NO: 1127)
CKAP5-5302 Target: 5'-TTCGACTGTTGCCTGATACCATCAATA-3' (SEQ ID NO: 1703)

5'-GUUGCCUGAUACCAUCAAUAGCAUU-3'   (SEQ ID NO: 2280)
                3'-GACAACGGACUAUGGUAGUUAUCGUAA-5' (SEQ ID NO: 1128)
CKAP5-5307 Target: 5'-CTGTTGCCTGATACCATCAATAGCATT-3' (SEQ ID NO: 1704)

5'-CUGAUACCAUCAAUAGCAUUAACCU-3'   (SEQ ID NO: 2281)
                3'-CGGACUAUGGUAGUUAUCGUAAUUGGA-5' (SEQ ID NO: 1129)
CKAP5-5312 Target: 5'-GCCTGATACCATCAATAGCATTAACCT-3' (SEQ ID NO: 1705)

5'-AUCAAUAGCAUUAACCUAGACAGAA-3'   (SEQ ID NO: 2282)
                3'-GGUAGUUAUCGUAAUUGGAUCUGUCUU-5' (SEQ ID NO: 1130)
CKAP5-5320 Target: 5'-CCATCAATAGCATTAACCTAGACAGAA-3' (SEQ ID NO: 1706)
```

TABLE 3-continued

Selected Human Anti-CKAP5 DsiRNAs, Unmodified Duplexes (Asymmetrics)

```
                5'-UAGCAUUAACCUAGACAGAAUUCUU-3'    (SEQ ID NO: 2283)
                3'-UUAUCGUAAUUGGAUCUGUCUUAAGAA-5'  (SEQ ID NO: 1131)
CKAP5-5325 Target:5'-AATAGCATTAACCTAGACAGAATTCTT-3' (SEQ ID NO: 1707)

5'-GAAUUCUUCUGGAUAUCCACAUUUU-3'    (SEQ ID NO: 2284)
                3'-GUCUUAAGAAGACCUAUAGGUGUAAAA-5'  (SEQ ID NO: 1132)
CKAP5-5342 Target:5'-CAGAATTCTTCTGGATATCCACATTTT-3' (SEQ ID NO: 1708)

5'-CUGGAUAUCCACAUUUUCAUGAAGG-3'    (SEQ ID NO: 2285)
                3'-AAGACCUAUAGGUGUAAAAGUACUUCC-5'  (SEQ ID NO: 1133)
CKAP5-5350 Target:5'-TTCTGGATATCCACATTTTCATGAAGG-3' (SEQ ID NO: 1709)

5'-AAAGAGAAACUGAAGCAAUGCAAAA-3'    (SEQ ID NO: 2286)
                3'-GGUUUCUCUUUGACUUCGUUACGUUUU-5'  (SEQ ID NO: 1134)
CKAP5-5383 Target:5'-CCAAAGAGAAACTGAAGCAATGCAAAA-3' (SEQ ID NO: 1710)

5'-GAAACUGAAGCAAUGCAAAAGUGAA-3'    (SEQ ID NO: 2287)
                3'-CUCUUUGACUUCGUUACGUUUUCACUU-5'  (SEQ ID NO: 1135)
CKAP5-5388 Target:5'-GAGAAACTGAAGCAATGCAAAAGTGAA-3' (SEQ ID NO: 1711)

5'-CGGAUGAUGAAGCACAGUAUGGACC-3'    (SEQ ID NO: 2288)
                3'-CGGCCUACUACUUCGUGUCAUACCUGG-5'  (SEQ ID NO: 1136)
CKAP5-5536 Target:5'-GCCGGATGATGAAGCACAGTATGGACC-3' (SEQ ID NO: 1712)

5'-CAGAAAAGGGAGCAUCUCGAAUAGA-3'    (SEQ ID NO: 2289)
                3'-UUGUCUUUUCCCUCGUAGAGCUUAUCU-5'  (SEQ ID NO: 1137)
CKAP5-5588 Target:5'-AACAGAAAAGGGAGCATCTCGAATAGA-3' (SEQ ID NO: 1713)

5'-AGGGAGCAUCUCGAAUAGAUGAAAA-3'    (SEQ ID NO: 2290)
                3'-UUUCCCUCGUAGAGCUUAUCUACUUUU-5'  (SEQ ID NO: 1138)
CKAP5-5594 Target:5'-AAAGGGAGCATCTCGAATAGATGAAAA-3' (SEQ ID NO: 1714)

5'-GCAUCUCGAAUAGAUGAAAAAUCAU-3'    (SEQ ID NO: 2291)
                3'-CUCGUAGAGCUUAUCUACUUUUUAGUA-5'  (SEQ ID NO: 1139)
CKAP5-5599 Target:5'-GAGCATCTCGAATAGATGAAAAATCAT-3' (SEQ ID NO: 1715)

5'-GAGGGACUAGCAGAGUUAUAUGAAU-3'    (SEQ ID NO: 2292)
                3'-UUCUCCCUGAUCGUCUCAAUAUACUUA-5'  (SEQ ID NO: 1140)
CKAP5-5692 Target:5'-AAGAGGGACTAGCAGAGTTATATGAAT-3' (SEQ ID NO: 1716)

5'-ACUCAGAUGCUGACAUUGAACCAUU-3'    (SEQ ID NO: 2293)
                3'-UAUGAGUCUACGACUGUAACUUGGUAA-5'  (SEQ ID NO: 1141)
CKAP5-5729 Target:5'-ATACTCAGATGCTGACATTGAACCATT-3' (SEQ ID NO: 1717)

5'-CAUUCAGACCUGGAUUCUAACCAGA-3'    (SEQ ID NO: 2294)
                3'-UCGUAAGUCUGGACCUAAGAUUGGUCU-5'  (SEQ ID NO: 1142)
CKAP5-6130 Target:5'-AGCATTCAGACCTGGATTCTAACCAGA-3' (SEQ ID NO: 1718)

5'-GACCUGGAUUCUAACCAGACUCACU-3'    (SEQ ID NO: 2295)
                3'-GUCUGGACCUAAGAUUGGUCUGAGUGA-5'  (SEQ ID NO: 1143)
CKAP5-6136 Target:5'-CAGACCTGGATTCTAACCAGACTCACT-3' (SEQ ID NO: 1719)

5'-GGAUUCUAACCAGACUCACUCUUCA-3'    (SEQ ID NO: 2296)
                3'-GACCUAAGAUUGGUCUGAGUGAGAAGU-5'  (SEQ ID NO: 1144)
CKAP5-6141 Target:5'-CTGGATTCTAACCAGACTCACTCTTCA-3' (SEQ ID NO: 1720)

5'-GCUAACAUAGACGACUUGAAAAAAA-3'    (SEQ ID NO: 2297)
                3'-GUCGAUUGUAUCUGCUGAACUUUUUUU-5'  (SEQ ID NO: 1145)
CKAP5-6193 Target:5'-CAGCTAACATAGACGACTTGAAAAAAA-3' (SEQ ID NO: 1721)

5'-CAUAGACGACUUGAAAAAAAGACUG-3'    (SEQ ID NO: 2298)
                3'-UUGUAUCUGCUGAACUUUUUUUCUGAC-5'  (SEQ ID NO: 1146)
CKAP5-6198 Target:5'-AACATAGACGACTTGAAAAAAAGACTG-3' (SEQ ID NO: 1722)

5'-CUAGAAGUCCUCAUAGUUUAAAAUG-3'    (SEQ ID NO: 2299)
                3'-UUGAUCUUCAGGAGUAUCAAAUUUUAC-5'  (SEQ ID NO: 1147)
CKAP5-6294 Target:5'-AACTAGAAGTCCTCATAGTTTAAAATG-3' (SEQ ID NO: 1723)

5'-GAUGAGUUUAGUGUACAGACUUGUA-3'    (SEQ ID NO: 2300)
                3'-ACCUACUCAAAUCACAUGUCUGAACAU-5'  (SEQ ID NO: 1148)
CKAP5-6459 Target:5'-TGGATGAGTTTAGTGTACAGACTTGTA-3' (SEQ ID NO: 1724)

5'-CAGAUCCUUUUCUUUUCUUUUUAAU-3'    (SEQ ID NO: 2301)
                3'-GGGUCUAGGAAAAGAAAAGAAAAAUUA-5'  (SEQ ID NO: 1149)
CKAP5-6517 Target:5'-CCCAGATCCTTTTCTTTTCTTTTTAAT-3' (SEQ ID NO: 1725)
```

TABLE 3-continued

Selected Human Anti-CKAP5 DsiRNAs, Unmodified Duplexes (Asymmetrics)

```
                5'-UGCUCAUUUGUAAAAUUGUCCUAAU-3'      (SEQ ID NO: 2302)
                3'-UAACGAGUAAACAUUUUAACAGGAUUA-5'    (SEQ ID NO: 1150)
CKAP5-6542 Target: 5'-ATTGCTCATTTGTAAAATTGTCCTAAT-3' (SEQ ID NO: 1726)

5'-GAAGGGUCACUGUAUUCUGUAUGAA-3'      (SEQ ID NO: 2303)
                3'-GACUUCCCAGUGACAUAAGACAUACUU-5'    (SEQ ID NO: 1151)
CKAP5-6648 Target: 5'-CTGAAGGGTCACTGTATTCTGTATGAA-3' (SEQ ID NO: 1727)

5'-GUCACUGUAUUCUGUAUGAAUGCAU-3'      (SEQ ID NO: 2304)
                3'-CCCAGUGACAUAAGACAUACUUACGUA-5'    (SEQ ID NO: 1152)
CKAP5-6653 Target: 5'-GGGTCACTGTATTCTGTATGAATGCAT-3' (SEQ ID NO: 1728)
```

TABLE 4

DsiRNA Target Sequences (21mers) In CKAP5 mRNA

```
CKAP5-143 21 nt Target:  5'-UGGAAGCACAAUGGGAGAUGA-3'  (SEQ ID NO: 2305)
CKAP5-145 21 nt Target:  5'-GAAGCACAAUGGGAGAUGACA-3'  (SEQ ID NO: 2306)
CKAP5-147 21 nt Target:  5'-AGCACAAUGGGAGAUGACAGU-3'  (SEQ ID NO: 2307)
CKAP5-149 21 nt Target:  5'-CACAAUGGGAGAUGACAGUGA-3'  (SEQ ID NO: 2308)
CKAP5-151 21 nt Target:  5'-CAAUGGGAGAUGACAGUGAGU-3'  (SEQ ID NO: 2309)
CKAP5-153 21 nt Target:  5'-AUGGGAGAUGACAGUGAGUGG-3'  (SEQ ID NO: 2310)
CKAP5-155 21 nt Target:  5'-GGGAGAUGACAGUGAGUGGUU-3'  (SEQ ID NO: 2311)
CKAP5-157 21 nt Target:  5'-GAGAUGACAGUGAGUGGUUGA-3'  (SEQ ID NO: 2312)
CKAP5-159 21 nt Target:  5'-GAUGACAGUGAGUGGUUGAAA-3'  (SEQ ID NO: 2313)
CKAP5-246 21 nt Target:  5'-CUGAAGAUCUUCCAGAAAAUA-3'  (SEQ ID NO: 2314)
CKAP5-248 21 nt Target:  5'-GAAGAUCUUCCAGAAAAUAAA-3'  (SEQ ID NO: 2315)
CKAP5-250 21 nt Target:  5'-AGAUCUUCCAGAAAAUAAAGG-3'  (SEQ ID NO: 2316)
CKAP5-252 21 nt Target:  5'-AUCUUCCAGAAAAUAAAGGAU-3'  (SEQ ID NO: 2317)
CKAP5-254 21 nt Target:  5'-CUUCCAGAAAAUAAAGGAUGA-3'  (SEQ ID NO: 2318)
CKAP5-256 21 nt Target:  5'-UCCAGAAAAUAAAGGAUGAAA-3'  (SEQ ID NO: 2319)
CKAP5-258 21 nt Target:  5'-CAGAAAAUAAAGGAUGAAAAG-3'  (SEQ ID NO: 2320)
CKAP5-260 21 nt Target:  5'-GAAAAUAAAGGAUGAAAAGAG-3'  (SEQ ID NO: 2321)
CKAP5-308 21 nt Target:  5'-GAUCAAAAAAUUUGUCACUGA-3'  (SEQ ID NO: 2322)
CKAP5-310 21 nt Target:  5'-UCAAAAAAUUUGUCACUGAUU-3'  (SEQ ID NO: 2323)
CKAP5-312 21 nt Target:  5'-AAAAAAUUUGUCACUGAUUCC-3'  (SEQ ID NO: 2324)
CKAP5-314 21 nt Target:  5'-AAAAUUUGUCACUGAUUCCAA-3'  (SEQ ID NO: 2325)
CKAP5-316 21 nt Target:  5'-AAUUUGUCACUGAUUCCAAUG-3'  (SEQ ID NO: 2326)
CKAP5-318 21 nt Target:  5'-UUUGUCACUGAUUCCAAUGCA-3'  (SEQ ID NO: 2327)
CKAP5-320 21 nt Target:  5'-UGUCACUGAUUCCAAUGCAGU-3'  (SEQ ID NO: 2328)
CKAP5-322 21 nt Target:  5'-UCACUGAUUCCAAUGCAGUGG-3'  (SEQ ID NO: 2329)
CKAP5-324 21 nt Target:  5'-ACUGAUUCCAAUGCAGUGGUU-3'  (SEQ ID NO: 2330)
CKAP5-326 21 nt Target:  5'-UGAUUCCAAUGCAGUGGUUCA-3'  (SEQ ID NO: 2331)
CKAP5-328 21 nt Target:  5'-AUUCCAAUGCAGUGGUUCAAU-3'  (SEQ ID NO: 2332)
CKAP5-330 21 nt Target:  5'-UCCAAUGCAGUGGUUCAAUUG-3'  (SEQ ID NO: 2333)
```

TABLE 4-continued

DsiRNA Target Sequences (21mers) In CKAP5 mRNA

| | | |
|---|---|---|
| CKAP5-332 21 nt Target: | 5'-CAAUGCAGUGGUUCAAUUGAA-3' | (SEQ ID NO: 2334) |
| CKAP5-334 21 nt Target: | 5'-AUGCAGUGGUUCAAUUGAAAG-3' | (SEQ ID NO: 2335) |
| CKAP5-336 21 nt Target: | 5'-GCAGUGGUUCAAUUGAAAGGA-3' | (SEQ ID NO: 2336) |
| CKAP5-565 21 nt Target: | 5'-CCAAGAUCAUAGUGGCCUGUA-3' | (SEQ ID NO: 2337) |
| CKAP5-567 21 nt Target: | 5'-AAGAUCAUAGUGGCCUGUAUA-3' | (SEQ ID NO: 2338) |
| CKAP5-569 21 nt Target: | 5'-GAUCAUAGUGGCCUGUAUAGA-3' | (SEQ ID NO: 2339) |
| CKAP5-590 21 nt Target: | 5'-GACACUGAGGAAAGCCUUAAG-3' | (SEQ ID NO: 2340) |
| CKAP5-592 21 nt Target: | 5'-CACUGAGGAAAGCCUUAAGUG-3' | (SEQ ID NO: 2341) |
| CKAP5-594 21 nt Target: | 5'-CUGAGGAAAGCCUUAAGUGAA-3' | (SEQ ID NO: 2342) |
| CKAP5-596 21 nt Target: | 5'-GAGGAAAGCCUUAAGUGAAUU-3' | (SEQ ID NO: 2343) |
| CKAP5-598 21 nt Target: | 5'-GGAAAGCCUUAAGUGAAUUUG-3' | (SEQ ID NO: 2344) |
| CKAP5-600 21 nt Target: | 5'-AAAGCCUUAAGUGAAUUUGGU-3' | (SEQ ID NO: 2345) |
| CKAP5-602 21 nt Target: | 5'-AGCCUUAAGUGAAUUUGGUUC-3' | (SEQ ID NO: 2346) |
| CKAP5-604 21 nt Target: | 5'-CCUUAAGUGAAUUUGGUUCCA-3' | (SEQ ID NO: 2347) |
| CKAP5-606 21 nt Target: | 5'-UUAAGUGAAUUUGGUUCCAAA-3' | (SEQ ID NO: 2348) |
| CKAP5-608 21 nt Target: | 5'-AAGUGAAUUUGGUUCCAAAAU-3' | (SEQ ID NO: 2349) |
| CKAP5-610 21 nt Target: | 5'-GUGAAUUUGGUUCCAAAAUCA-3' | (SEQ ID NO: 2350) |
| CKAP5-612 21 nt Target: | 5'-GAAUUUGGUUCCAAAAUCAUC-3' | (SEQ ID NO: 2351) |
| CKAP5-847 21 nt Target: | 5'-UUCGUUCCCAACAAGAACUAG-3' | (SEQ ID NO: 2352) |
| CKAP5-849 21 nt Target: | 5'-CGUUCCCAACAAGAACUAGAA-3' | (SEQ ID NO: 2353) |
| CKAP5-851 21 nt Target: | 5'-UUCCCAACAAGAACUAGAAGC-3' | (SEQ ID NO: 2354) |
| CKAP5-853 21 nt Target: | 5'-CCCAACAAGAACUAGAAGCUA-3' | (SEQ ID NO: 2355) |
| CKAP5-855 21 nt Target: | 5'-CAACAAGAACUAGAAGCUAAA-3' | (SEQ ID NO: 2356) |
| CKAP5-884 21 nt Target: | 5'-ACAACAGUCUGCUGGUGGAGA-3' | (SEQ ID NO: 2357) |
| CKAP5-886 21 nt Target: | 5'-AACAGUCUGCUGGUGGAGAUG-3' | (SEQ ID NO: 2358) |
| CKAP5-914 21 nt Target: | 5'-AGGUGGUGAUGAUGGUGAUGA-3' | (SEQ ID NO: 2359) |
| CKAP5-916 21 nt Target: | 5'-GUGGUGAUGAUGGUGAUGAGG-3' | (SEQ ID NO: 2360) |
| CKAP5-976 21 nt Target: | 5'-AAAUCCUUUCCAAACUUCCCA-3' | (SEQ ID NO: 2361) |
| CKAP5-978 21 nt Target: | 5'-AUCCUUUCCAAACUUCCCAAA-3' | (SEQ ID NO: 2362) |
| CKAP5-980 21 nt Target: | 5'-CCUUUCCAAACUUCCCAAAGA-3' | (SEQ ID NO: 2363) |
| CKAP5-982 21 nt Target: | 5'-UUUCCAAACUUCCCAAAGACU-3' | (SEQ ID NO: 2364) |
| CKAP5-984 21 nt Target: | 5'-UCCAAACUUCCCAAAGACUUU-3' | (SEQ ID NO: 2365) |
| CKAP5-986 21 nt Target: | 5'-CAAACUUCCCAAAGACUUUUA-3' | (SEQ ID NO: 2366) |
| CKAP5-988 21 nt Target: | 5'-AACUUCCCAAAGACUUUUAUG-3' | (SEQ ID NO: 2367) |
| CKAP5-990 21 nt Target: | 5'-CUUCCCAAAGACUUUUAUGAC-3' | (SEQ ID NO: 2368) |
| CKAP5-992 21 nt Target: | 5'-UCCCAAAGACUUUUAUGACAA-3' | (SEQ ID NO: 2369) |
| CKAP5-994 21 nt Target: | 5'-CCAAAGACUUUUAUGACAAAA-3' | (SEQ ID NO: 2370) |
| CKAP5-996 21 nt Target: | 5'-AAAGACUUUUAUGACAAAAUU-3' | (SEQ ID NO: 2371) |
| CKAP5-998 21 nt Target: | 5'-AGACUUUUAUGACAAAAUUGA-3' | (SEQ ID NO: 2372) |

TABLE 4-continued

DsiRNA Target Sequences (21mers) In CKAP5 mRNA

| | | |
|---|---|---|
| CKAP5-1000 21 nt Target: | 5'-ACUUUAUGACAAAAUUGAGG-3' | (SEQ ID NO: 2373) |
| CKAP5-1002 21 nt Target: | 5'-UUUUAUGACAAAAUUGAGGCA-3' | (SEQ ID NO: 2374) |
| CKAP5-1004 21 nt Target: | 5'-UUAUGACAAAAUUGAGGCAAA-3' | (SEQ ID NO: 2375) |
| CKAP5-1025 21 nt Target: | 5'-AAAAUGGCAAGAGAGAAAAGA-3' | (SEQ ID NO: 2376) |
| CKAP5-1127 21 nt Target: | 5'-GAAGGUUGUUGGAAAGGACAC-3' | (SEQ ID NO: 2377) |
| CKAP5-1129 21 nt Target: | 5'-AGGUUGUUGGAAAGGACACCA-3' | (SEQ ID NO: 2378) |
| CKAP5-1131 21 nt Target: | 5'-GUUGUUGGAAAGGACACCAAU-3' | (SEQ ID NO: 2379) |
| CKAP5-1133 21 nt Target: | 5'-UGUUGGAAAGGACACCAAUGU-3' | (SEQ ID NO: 2380) |
| CKAP5-1135 21 nt Target: | 5'-UUGGAAAGGACACCAAUGUCA-3' | (SEQ ID NO: 2381) |
| CKAP5-1137 21 nt Target: | 5'-GGAAAGGACACCAAUGUCAUG-3' | (SEQ ID NO: 2382) |
| CKAP5-1139 21 nt Target: | 5'-AAAGGACACCAAUGUCAUGUU-3' | (SEQ ID NO: 2383) |
| CKAP5-1141 21 nt Target: | 5'-AGGACACCAAUGUCAUGUUGG-3' | (SEQ ID NO: 2384) |
| CKAP5-1162 21 nt Target: | 5'-UGGCUUUGGCAGCAAAAUGUC-3' | (SEQ ID NO: 2385) |
| CKAP5-1164 21 nt Target: | 5'-GCUUUGGCAGCAAAAUGUCUU-3' | (SEQ ID NO: 2386) |
| CKAP5-1166 21 nt Target: | 5'-UUUGGCAGCAAAAUGUCUUAC-3' | (SEQ ID NO: 2387) |
| CKAP5-1168 21 nt Target: | 5'-UGGCAGCAAAAUGUCUUACUG-3' | (SEQ ID NO: 2388) |
| CKAP5-1170 21 nt Target: | 5'-GCAGCAAAAUGUCUUACUGGC-3' | (SEQ ID NO: 2389) |
| CKAP5-1208 21 nt Target: | 5'-GAAGAAAUUUGGACAAUAUGC-3' | (SEQ ID NO: 2390) |
| CKAP5-1210 21 nt Target: | 5'-AGAAAUUUGGACAAUAUGCAG-3' | (SEQ ID NO: 2391) |
| CKAP5-1212 21 nt Target: | 5'-AAAUUUGGACAAUAUGCAGGA-3' | (SEQ ID NO: 2392) |
| CKAP5-1214 21 nt Target: | 5'-AUUUGGACAAUAUGCAGGACA-3' | (SEQ ID NO: 2393) |
| CKAP5-1216 21 nt Target: | 5'-UUGGACAAUAUGCAGGACAUG-3' | (SEQ ID NO: 2394) |
| CKAP5-1218 21 nt Target: | 5'-GGACAAUAUGCAGGACAUGUU-3' | (SEQ ID NO: 2395) |
| CKAP5-1220 21 nt Target: | 5'-ACAAUAUGCAGGACAUGUUGU-3' | (SEQ ID NO: 2396) |
| CKAP5-1222 21 nt Target: | 5'-AAUAUGCAGGACAUGUUGUGC-3' | (SEQ ID NO: 2397) |
| CKAP5-1224 21 nt Target: | 5'-UAUGCAGGACAUGUUGUGCCA-3' | (SEQ ID NO: 2398) |
| CKAP5-1226 21 nt Target: | 5'-UGCAGGACAUGUUGUGCCAAC-3' | (SEQ ID NO: 2399) |
| CKAP5-1274 21 nt Target: | 5'-ACCUCAAGUGGUACAAGCCCU-3' | (SEQ ID NO: 2400) |
| CKAP5-1276 21 nt Target: | 5'-CUCAAGUGGUACAAGCCCUGC-3' | (SEQ ID NO: 2401) |
| CKAP5-1278 21 nt Target: | 5'-CAAGUGGUACAAGCCCUGCAG-3' | (SEQ ID NO: 2402) |
| CKAP5-1280 21 nt Target: | 5'-AGUGGUACAAGCCCUGCAGGA-3' | (SEQ ID NO: 2403) |
| CKAP5-1282 21 nt Target: | 5'-UGGUACAAGCCCUGCAGGAGG-3' | (SEQ ID NO: 2404) |
| CKAP5-1284 21 nt Target: | 5'-GUACAAGCCCUGCAGGAGGCA-3' | (SEQ ID NO: 2405) |
| CKAP5-1286 21 nt Target: | 5'-ACAAGCCCUGCAGGAGGCAAU-3' | (SEQ ID NO: 2406) |
| CKAP5-1288 21 nt Target: | 5'-AAGCCCUGCAGGAGGCAAUUG-3' | (SEQ ID NO: 2407) |
| CKAP5-1290 21 nt Target: | 5'-GCCCUGCAGGAGGCAAUUGAU-3' | (SEQ ID NO: 2408) |
| CKAP5-1292 21 nt Target: | 5'-CCUGCAGGAGGCAAUUGAUGC-3' | (SEQ ID NO: 2409) |
| CKAP5-1294 21 nt Target: | 5'-UGCAGGAGGCAAUUGAUGCAA-3' | (SEQ ID NO: 2410) |
| CKAP5-1296 21 nt Target: | 5'-CAGGAGGCAAUUGAUGCAAUC-3' | (SEQ ID NO: 2411) |

TABLE 4-continued

DsiRNA Target Sequences (21mers) In CKAP5 mRNA

```
CKAP5-1298   21 nt Target: 5'-GGAGGCAAUUGAUGCAAUCUU-3'  (SEQ ID NO: 2412)

CKAP5-1300   21 nt Target: 5'-AGGCAAUUGAUGCAAUCUUCC-3'  (SEQ ID NO: 2413)

CKAP5-1321   21 nt Target: 5'-UUACUACCACACUACAGAACA-3'  (SEQ ID NO: 2414)

CKAP5-1323   21 nt Target: 5'-ACUACCACACUACAGAACAUC-3'  (SEQ ID NO: 2415)

CKAP5-1325   21 nt Target: 5'-UACCACACUACAGAACAUCAG-3'  (SEQ ID NO: 2416)

CKAP5-1327   21 nt Target: 5'-CCACACUACAGAACAUCAGUG-3'  (SEQ ID NO: 2417)

CKAP5-1329   21 nt Target: 5'-ACACUACAGAACAUCAGUGAG-3'  (SEQ ID NO: 2418)

CKAP5-1331   21 nt Target: 5'-ACUACAGAACAUCAGUGAGGA-3'  (SEQ ID NO: 2419)

CKAP5-1333   21 nt Target: 5'-UACAGAACAUCAGUGAGGAUG-3'  (SEQ ID NO: 2420)

CKAP5-1354   21 nt Target: 5'-UUUUAGCAGUAAUGGAUAAUA-3'  (SEQ ID NO: 2421)

CKAP5-1356   21 nt Target: 5'-UUAGCAGUAAUGGAUAAUAAA-3'  (SEQ ID NO: 2422)

CKAP5-1358   21 nt Target: 5'-AGCAGUAAUGGAUAAUAAAAA-3'  (SEQ ID NO: 2423)

CKAP5-1360   21 nt Target: 5'-CAGUAAUGGAUAAUAAAAAUC-3'  (SEQ ID NO: 2424)

CKAP5-1381   21 nt Target: 5'-CAACCAUCAAGCAGCAGACAU-3'  (SEQ ID NO: 2425)

CKAP5-1480   21 nt Target: 5'-CACUACUUAAGCACAUCAAUG-3'  (SEQ ID NO: 2426)

CKAP5-1482   21 nt Target: 5'-CUACUUAAGCACAUCAAUGAU-3'  (SEQ ID NO: 2427)

CKAP5-1484   21 nt Target: 5'-ACUUAAGCACAUCAAUGAUUC-3'  (SEQ ID NO: 2428)

CKAP5-1486   21 nt Target: 5'-UUAAGCACAUCAAUGAUUCUG-3'  (SEQ ID NO: 2429)

CKAP5-1488   21 nt Target: 5'-AAGCACAUCAAUGAUUCUGCU-3'  (SEQ ID NO: 2430)

CKAP5-1490   21 nt Target: 5'-GCACAUCAAUGAUUCUGCUCC-3'  (SEQ ID NO: 2431)

CKAP5-1492   21 nt Target: 5'-ACAUCAAUGAUUCUGCUCCUG-3'  (SEQ ID NO: 2432)

CKAP5-1494   21 nt Target: 5'-AUCAAUGAUUCUGCUCCUGAA-3'  (SEQ ID NO: 2433)

CKAP5-1496   21 nt Target: 5'-CAAUGAUUCUGCUCCUGAAGU-3'  (SEQ ID NO: 2434)

CKAP5-1498   21 nt Target: 5'-AUGAUUCUGCUCCUGAAGUCA-3'  (SEQ ID NO: 2435)

CKAP5-1500   21 nt Target: 5'-GAUUCUGCUCCUGAAGUCAGA-3'  (SEQ ID NO: 2436)

CKAP5-1502   21 nt Target: 5'-UUCUGCUCCUGAAGUCAGAGA-3'  (SEQ ID NO: 2437)

CKAP5-1504   21 nt Target: 5'-CUGCUCCUGAAGUCAGAGAUG-3'  (SEQ ID NO: 2438)

CKAP5-1617   21 nt Target: 5'-AAGAUCAAAGAAUGUUCAGAA-3'  (SEQ ID NO: 2439)

CKAP5-1619   21 nt Target: 5'-GAUCAAAGAAUGUUCAGAAAA-3'  (SEQ ID NO: 2440)

CKAP5-2090   21 nt Target: 5'-GAAACCUGGAUGGAAAGAAAC-3'  (SEQ ID NO: 2441)

CKAP5-2092   21 nt Target: 5'-AACCUGGAUGGAAAGAAACUA-3'  (SEQ ID NO: 2442)

CKAP5-2094   21 nt Target: 5'-CCUGGAUGGAAAGAAACUAAU-3'  (SEQ ID NO: 2443)

CKAP5-2096   21 nt Target: 5'-UGGAUGGAAAGAAACUAAUUU-3'  (SEQ ID NO: 2444)

CKAP5-2098   21 nt Target: 5'-GAUGGAAAGAAACUAAUUUUC-3'  (SEQ ID NO: 2445)

CKAP5-2100   21 nt Target: 5'-UGGAAAGAAACUAAUUUUCAG-3'  (SEQ ID NO: 2446)

CKAP5-2102   21 nt Target: 5'-GAAAGAAACUAAUUUUCAGGU-3'  (SEQ ID NO: 2447)

CKAP5-2104   21 nt Target: 5'-AAGAAACUAAUUUUCAGGUGA-3'  (SEQ ID NO: 2448)

CKAP5-2106   21 nt Target: 5'-GAAACUAAUUUUCAGGUGAUG-3'  (SEQ ID NO: 2449)

CKAP5-2108   21 nt Target: 5'-AACUAAUUUUCAGGUGAUGCA-3'  (SEQ ID NO: 2450)
```

TABLE 4-continued

DsiRNA Target Sequences (21mers) In CKAP5 mRNA

```
CKAP5-2144 21 nt Target: 5'-AGUUGCUUUGAUUGCCCAGAA-3'  (SEQ ID NO: 2451)
CKAP5-2146 21 nt Target: 5'-UUGCUUUGAUUGCCCAGAAGG-3'  (SEQ ID NO: 2452)
CKAP5-2148 21 nt Target: 5'-GCUUUGAUUGCCCAGAAGGGA-3'  (SEQ ID NO: 2453)
CKAP5-2150 21 nt Target: 5'-UUUGAUUGCCCAGAAGGGAAA-3'  (SEQ ID NO: 2454)
CKAP5-2152 21 nt Target: 5'-UGAUUGCCCAGAAGGGAAAUU-3'  (SEQ ID NO: 2455)
CKAP5-2154 21 nt Target: 5'-AUUGCCCAGAAGGGAAAUUUU-3'  (SEQ ID NO: 2456)
CKAP5-2156 21 nt Target: 5'-UGCCCAGAAGGGAAAUUUUC-3'   (SEQ ID NO: 2457)
CKAP5-2212 21 nt Target: 5'-UGGACAAGAUUGGAGAUGUGA-3'  (SEQ ID NO: 2458)
CKAP5-2214 21 nt Target: 5'-GACAAGAUUGGAGAUGUGAAA-3'  (SEQ ID NO: 2459)
CKAP5-2216 21 nt Target: 5'-CAAGAUUGGAGAUGUGAAAUG-3'  (SEQ ID NO: 2460)
CKAP5-2218 21 nt Target: 5'-AGAUUGGAGAUGUGAAAUGUG-3'  (SEQ ID NO: 2461)
CKAP5-2220 21 nt Target: 5'-AUUGGAGAUGUGAAAUGUGGG-3'  (SEQ ID NO: 2462)
CKAP5-2222 21 nt Target: 5'-UGGAGAUGUGAAAUGUGGGAA-3'  (SEQ ID NO: 2463)
CKAP5-2224 21 nt Target: 5'-GAGAUGUGAAAUGUGGGAACA-3'  (SEQ ID NO: 2464)
CKAP5-2226 21 nt Target: 5'-GAUGUGAAAUGUGGGAACAAU-3'  (SEQ ID NO: 2465)
CKAP5-2228 21 nt Target: 5'-UGUGAAAUGUGGGAACAAUGC-3'  (SEQ ID NO: 2466)
CKAP5-2230 21 nt Target: 5'-UGAAAUGUGGGAACAAUGCAA-3'  (SEQ ID NO: 2467)
CKAP5-2232 21 nt Target: 5'-AAAUGUGGGAACAAUGCAAAA-3'  (SEQ ID NO: 2468)
CKAP5-2234 21 nt Target: 5'-AUGUGGGAACAAUGCAAAGA-3'   (SEQ ID NO: 2469)
CKAP5-2236 21 nt Target: 5'-GUGGGAACAAUGCAAAGAAG-3'    (SEQ ID NO: 2470)
CKAP5-2400 21 nt Target: 5'-GGGUUGAAUGUCAAAGCUUUC-3'  (SEQ ID NO: 2471)
CKAP5-2402 21 nt Target: 5'-GUUGAAUGUCAAAGCUUUCAU-3'  (SEQ ID NO: 2472)
CKAP5-2404 21 nt Target: 5'-UGAAUGUCAAAGCUUUCAUUA-3'  (SEQ ID NO: 2473)
CKAP5-2406 21 nt Target: 5'-AAUGUCAAAGCUUUCAUUAGC-3'  (SEQ ID NO: 2474)
CKAP5-2408 21 nt Target: 5'-UGUCAAAGCUUUCAUUAGCAA-3'  (SEQ ID NO: 2475)
CKAP5-2480 21 nt Target: 5'-AACCCUGCUUGGCGUGAUGUA-3'  (SEQ ID NO: 2476)
CKAP5-2482 21 nt Target: 5'-CCCUGCUUGGCGUGAUGUAUC-3'  (SEQ ID NO: 2477)
CKAP5-2528 21 nt Target: 5'-GUUCUUUGAGGAUGAGAAGCC-3'  (SEQ ID NO: 2478)
CKAP5-2530 21 nt Target: 5'-UCUUUGAGGAUGAGAAGCCUG-3'  (SEQ ID NO: 2479)
CKAP5-2532 21 nt Target: 5'-UUUGAGGAUGAGAAGCCUGCC-3'  (SEQ ID NO: 2480)
CKAP5-2534 21 nt Target: 5'-UGAGGAUGAGAAGCCUGCCCU-3'  (SEQ ID NO: 2481)
CKAP5-2536 21 nt Target: 5'-AGGAUGAGAAGCCUGCCCUCC-3'  (SEQ ID NO: 2482)
CKAP5-2538 21 nt Target: 5'-GAUGAGAAGCCUGCCCUCCUA-3'  (SEQ ID NO: 2483)
CKAP5-2540 21 nt Target: 5'-UGAGAAGCCUGCCCUCCUAUC-3'  (SEQ ID NO: 2484)
CKAP5-2542 21 nt Target: 5'-AGAAGCCUGCCCUCCUAUCCC-3'  (SEQ ID NO: 2485)
CKAP5-2544 21 nt Target: 5'-AAGCCUGCCCUCCUAUCCCAG-3'  (SEQ ID NO: 2486)
CKAP5-2546 21 nt Target: 5'-GCCUGCCCUCCUAUCCCAGAU-3'  (SEQ ID NO: 2487)
CKAP5-2548 21 nt Target: 5'-CUGCCCUCCUAUCCCAGAUAG-3'  (SEQ ID NO: 2488)
CKAP5-2550 21 nt Target: 5'-GCCCUCCUAUCCCAGAUAGAU-3'  (SEQ ID NO: 2489)
```

TABLE 4-continued

DsiRNA Target Sequences (21mers) In CKAP5 mRNA

```
CKAP5-2552  21 nt Target: 5'-CCUCCUAUCCCAGAUAGAUGC-3'  (SEQ ID NO: 2490)

CKAP5-2554  21 nt Target: 5'-UCCUAUCCCAGAUAGAUGCAG-3'  (SEQ ID NO: 2491)

CKAP5-2556  21 nt Target: 5'-CUAUCCCAGAUAGAUGCAGAA-3'  (SEQ ID NO: 2492)

CKAP5-2558  21 nt Target: 5'-AUCCCAGAUAGAUGCAGAAUU-3'  (SEQ ID NO: 2493)

CKAP5-2581  21 nt Target: 5'-AGAAGAUGCAGGGACAAAGUC-3'  (SEQ ID NO: 2494)

CKAP5-2643  21 nt Target: 5'-GGUACAGAUGAAGGAGAAGAU-3'  (SEQ ID NO: 2495)

CKAP5-2645  21 nt Target: 5'-UACAGAUGAAGGAGAAGAUGG-3'  (SEQ ID NO: 2496)

CKAP5-2647  21 nt Target: 5'-CAGAUGAAGGAGAAGAUGGAG-3'  (SEQ ID NO: 2497)

CKAP5-2695  21 nt Target: 5'-UCGUUGAUCUUUUGCCGAGGA-3'  (SEQ ID NO: 2498)

CKAP5-2780  21 nt Target: 5'-UAGGAAAGAAGGCCUAGAUGA-3'  (SEQ ID NO: 2499)

CKAP5-2782  21 nt Target: 5'-GGAAAGAAGGCCUAGAUGAAG-3'  (SEQ ID NO: 2500)

CKAP5-2784  21 nt Target: 5'-AAAGAAGGCCUAGAUGAAGUG-3'  (SEQ ID NO: 2501)

CKAP5-2786  21 nt Target: 5'-AGAAGGCCUAGAUGAAGUGGC-3'  (SEQ ID NO: 2502)

CKAP5-2788  21 nt Target: 5'-AAGGCCUAGAUGAAGUGGCAG-3'  (SEQ ID NO: 2503)

CKAP5-2790  21 nt Target: 5'-GGCCUAGAUGAAGUGGCAGGU-3'  (SEQ ID NO: 2504)

CKAP5-2792  21 nt Target: 5'-CCUAGAUGAAGUGGCAGGUAU-3'  (SEQ ID NO: 2505)

CKAP5-2794  21 nt Target: 5'-UAGAUGAAGUGGCAGGUAUUA-3'  (SEQ ID NO: 2506)

CKAP5-2839  21 nt Target: 5'-CGAAUAUAGGUGAACUUCCAA-3'  (SEQ ID NO: 2507)

CKAP5-2841  21 nt Target: 5'-AAUAUAGGUGAACUUCCAACU-3'  (SEQ ID NO: 2508)

CKAP5-2843  21 nt Target: 5'-UAUAGGUGAACUUCCAACUGC-3'  (SEQ ID NO: 2509)

CKAP5-2845  21 nt Target: 5'-UAGGUGAACUUCCAACUGCCU-3'  (SEQ ID NO: 2510)

CKAP5-2847  21 nt Target: 5'-GGUGAACUUCCAACUGCCUUG-3'  (SEQ ID NO: 2511)

CKAP5-2849  21 nt Target: 5'-UGAACUUCCAACUGCCUUGAA-3'  (SEQ ID NO: 2512)

CKAP5-2851  21 nt Target: 5'-AACUUCCAACUGCCUUGAAGG-3'  (SEQ ID NO: 2513)

CKAP5-2853  21 nt Target: 5'-CUUCCAACUGCCUUGAAGGGU-3'  (SEQ ID NO: 2514)

CKAP5-2855  21 nt Target: 5'-UCCAACUGCCUUGAAGGGUCG-3'  (SEQ ID NO: 2515)

CKAP5-2857  21 nt Target: 5'-CAACUGCCUUGAAGGGUCGAC-3'  (SEQ ID NO: 2516)

CKAP5-2926  21 nt Target: 5'-AACAACUGGCAGUAGCCAUGG-3'  (SEQ ID NO: 2517)

CKAP5-3007  21 nt Target: 5'-ACAGCAAGAACAAUGUUCGAG-3'  (SEQ ID NO: 2518)

CKAP5-3009  21 nt Target: 5'-AGCAAGAACAAUGUUCGAGCU-3'  (SEQ ID NO: 2519)

CKAP5-3011  21 nt Target: 5'-CAAGAACAAUGUUCGAGCUGC-3'  (SEQ ID NO: 2520)

CKAP5-3013  21 nt Target: 5'-AGAACAAUGUUCGAGCUGCUG-3'  (SEQ ID NO: 2521)

CKAP5-3015  21 nt Target: 5'-AACAAUGUUCGAGCUGCUGCC-3'  (SEQ ID NO: 2522)

CKAP5-3017  21 nt Target: 5'-CAAUGUUCGAGCUGCUGCCCU-3'  (SEQ ID NO: 2523)

CKAP5-3019  21 nt Target: 5'-AUGUUCGAGCUGCUGCCCUAG-3'  (SEQ ID NO: 2524)

CKAP5-3040  21 nt Target: 5'-CGACUGUGAAUGCUUGGGCAG-3'  (SEQ ID NO: 2525)

CKAP5-3042  21 nt Target: 5'-ACUGUGAAUGCUUGGGCAGAA-3'  (SEQ ID NO: 2526)

CKAP5-3044  21 nt Target: 5'-UGUGAAUGCUUGGGCAGAACA-3'  (SEQ ID NO: 2527)

CKAP5-3089  21 nt Target: 5'-AGGAGAAGAUCUUUCUGAAGA-3'  (SEQ ID NO: 2528)
```

TABLE 4-continued

DsiRNA Target Sequences (21mers) In CKAP5 mRNA

| | |
|---|---|
| CKAP5-3229 21 nt Target: 5'-GCCUAGAAGAUCGAAAUGGAG-3' | (SEQ ID NO: 2529) |
| CKAP5-3231 21 nt Target: 5'-CUAGAAGAUCGAAAUGGAGAU-3' | (SEQ ID NO: 2530) |
| CKAP5-3233 21 nt Target: 5'-AGAAGAUCGAAAUGGAGAUGU-3' | (SEQ ID NO: 2531) |
| CKAP5-3287 21 nt Target: 5'-CAUGAUGCAUUUAGGAUAUGA-3' | (SEQ ID NO: 2532) |
| CKAP5-3289 21 nt Target: 5'-UGAUGCAUUUAGGAUAUGAAA-3' | (SEQ ID NO: 2533) |
| CKAP5-3291 21 nt Target: 5'-AUGCAUUUAGGAUAUGAAAAA-3' | (SEQ ID NO: 2534) |
| CKAP5-3293 21 nt Target: 5'-GCAUUUAGGAUAUGAAAAAAU-3' | (SEQ ID NO: 2535) |
| CKAP5-3295 21 nt Target: 5'-AUUUAGGAUAUGAAAAAUGG-3' | (SEQ ID NO: 2536) |
| CKAP5-3316 21 nt Target: 5'-CCAAGGCUACUGGGAAACUAA-3' | (SEQ ID NO: 2537) |
| CKAP5-3318 21 nt Target: 5'-AAGGCUACUGGGAAACUAAAG-3' | (SEQ ID NO: 2538) |
| CKAP5-3320 21 nt Target: 5'-GGCUACUGGGAAACUAAAGCC-3' | (SEQ ID NO: 2539) |
| CKAP5-3322 21 nt Target: 5'-CUACUGGGAAACUAAAGCCAA-3' | (SEQ ID NO: 2540) |
| CKAP5-3324 21 nt Target: 5'-ACUGGGAAACUAAAGCCAACU-3' | (SEQ ID NO: 2541) |
| CKAP5-3326 21 nt Target: 5'-UGGGAAACUAAAGCCAACUUC-3' | (SEQ ID NO: 2542) |
| CKAP5-3328 21 nt Target: 5'-GGAAACUAAAGCCAACUUCUA-3' | (SEQ ID NO: 2543) |
| CKAP5-3330 21 nt Target: 5'-AAACUAAAGCCAACUUCUAAA-3' | (SEQ ID NO: 2544) |
| CKAP5-3332 21 nt Target: 5'-ACUAAAGCCAACUUCUAAAGA-3' | (SEQ ID NO: 2545) |
| CKAP5-3334 21 nt Target: 5'-UAAAGCCAACUUCUAAAGAUC-3' | (SEQ ID NO: 2546) |
| CKAP5-3625 21 nt Target: 5'-GGCCUAUUUUAUUGUUGUUC-3' | (SEQ ID NO: 2547) |
| CKAP5-3627 21 nt Target: 5'-CCUAUUUUAUUGUUGUUCCA-3' | (SEQ ID NO: 2548) |
| CKAP5-3629 21 nt Target: 5'-UAUUUUAUUGUUGUUCCAAA-3' | (SEQ ID NO: 2549) |
| CKAP5-3631 21 nt Target: 5'-UUUUUAUUGUUGUUCCAAAUG-3' | (SEQ ID NO: 2550) |
| CKAP5-3633 21 nt Target: 5'-UUUAUUGUUGUUCCAAAUGGA-3' | (SEQ ID NO: 2551) |
| CKAP5-3635 21 nt Target: 5'-UAUUGUUGUUCCAAAUGGAAA-3' | (SEQ ID NO: 2552) |
| CKAP5-3686 21 nt Target: 5'-GAAGGUGCUAAAGUGGAAUUU-3' | (SEQ ID NO: 2553) |
| CKAP5-3688 21 nt Target: 5'-AGGUGCUAAAGUGGAAUUUA-3' | (SEQ ID NO: 2554) |
| CKAP5-3989 21 nt Target: 5'-AUAUCAUCUUACUGAGAAUGA-3' | (SEQ ID NO: 2555) |
| CKAP5-3991 21 nt Target: 5'-AUCAUCUUACUGAGAAUGAAG-3' | (SEQ ID NO: 2556) |
| CKAP5-3993 21 nt Target: 5'-CAUCUUACUGAGAAUGAAGCA-3' | (SEQ ID NO: 2557) |
| CKAP5-3995 21 nt Target: 5'-UCUUACUGAGAAUGAAGCAUC-3' | (SEQ ID NO: 2558) |
| CKAP5-4038 21 nt Target: 5'-GUCAAGGUUGGAGAACCAAAG-3' | (SEQ ID NO: 2559) |
| CKAP5-4040 21 nt Target: 5'-CAAGGUUGGAGAACCAAAGGA-3' | (SEQ ID NO: 2560) |
| CKAP5-4042 21 nt Target: 5'-AGGUUGGAGAACCAAAGGAUG-3' | (SEQ ID NO: 2561) |
| CKAP5-4044 21 nt Target: 5'-GUUGGAGAACCAAAGGAUGUC-3' | (SEQ ID NO: 2562) |
| CKAP5-4046 21 nt Target: 5'-UGGAGAACCAAAGGAUGUCAU-3' | (SEQ ID NO: 2563) |
| CKAP5-4048 21 nt Target: 5'-GAGAACCAAAGGAUGUCAUUC-3' | (SEQ ID NO: 2564) |
| CKAP5-4050 21 nt Target: 5'-GAACCAAAGGAUGUCAUUCGU-3' | (SEQ ID NO: 2565) |
| CKAP5-4052 21 nt Target: 5'-ACCAAAGGAUGUCAUUCGUAA-3' | (SEQ ID NO: 2566) |
| CKAP5-4054 21 nt Target: 5'-CAAAGGAUGUCAUUCGUAAAG-3' | (SEQ ID NO: 2567) |

TABLE 4-continued

DsiRNA Target Sequences (21mers) In CKAP5 mRNA

| | | |
|---|---|---|
| CKAP5-4056 21 nt Target: | 5'-AAGGAUGUCAUUCGUAAAGAU-3' | (SEQ ID NO: 2568) |
| CKAP5-4058 21 nt Target: | 5'-GGAUGUCAUUCGUAAAGAUGU-3' | (SEQ ID NO: 2569) |
| CKAP5-4085 21 nt Target: | 5'-CAUCCUGAACCGGAUGUGCCU-3' | (SEQ ID NO: 2570) |
| CKAP5-4087 21 nt Target: | 5'-UCCUGAACCGGAUGUGCCUUG-3' | (SEQ ID NO: 2571) |
| CKAP5-4089 21 nt Target: | 5'-CUGAACCGGAUGUGCCUUGUC-3' | (SEQ ID NO: 2572) |
| CKAP5-4091 21 nt Target: | 5'-GAACCGGAUGUGCCUUGUCUA-3' | (SEQ ID NO: 2573) |
| CKAP5-4093 21 nt Target: | 5'-ACCGGAUGUGCCUUGUCUACC-3' | (SEQ ID NO: 2574) |
| CKAP5-4095 21 nt Target: | 5'-CGGAUGUGCCUUGUCUACCCA-3' | (SEQ ID NO: 2575) |
| CKAP5-4097 21 nt Target: | 5'-GAUGUGCCUUGUCUACCCAGC-3' | (SEQ ID NO: 2576) |
| CKAP5-4154 21 nt Target: | 5'-AUCCAAAAACUCUAAGCAGAG-3' | (SEQ ID NO: 2577) |
| CKAP5-4156 21 nt Target: | 5'-CCAAAAACUCUAAGCAGAGAG-3' | (SEQ ID NO: 2578) |
| CKAP5-4158 21 nt Target: | 5'-AAAAACUCUAAGCAGAGAGCA-3' | (SEQ ID NO: 2579) |
| CKAP5-4160 21 nt Target: | 5'-AAACUCUAAGCAGAGAGCAGA-3' | (SEQ ID NO: 2580) |
| CKAP5-4162 21 nt Target: | 5'-ACUCUAAGCAGAGAGCAGAGU-3' | (SEQ ID NO: 2581) |
| CKAP5-4164 21 nt Target: | 5'-UCUAAGCAGAGAGCAGAGUGC-3' | (SEQ ID NO: 2582) |
| CKAP5-4166 21 nt Target: | 5'-UAAGCAGAGAGCAGAGUGCCU-3' | (SEQ ID NO: 2583) |
| CKAP5-4168 21 nt Target: | 5'-AGCAGAGAGCAGAGUGCCUGG-3' | (SEQ ID NO: 2584) |
| CKAP5-4170 21 nt Target: | 5'-CAGAGAGCAGAGUGCCUGGAA-3' | (SEQ ID NO: 2585) |
| CKAP5-4172 21 nt Target: | 5'-GAGAGCAGAGUGCCUGGAAGA-3' | (SEQ ID NO: 2586) |
| CKAP5-4174 21 nt Target: | 5'-GAGCAGAGUGCCUGGAAGAGC-3' | (SEQ ID NO: 2587) |
| CKAP5-4241 21 nt Target: | 5'-CCCAGGAAAAGCCUUAAAGGA-3' | (SEQ ID NO: 2588) |
| CKAP5-4346 21 nt Target: | 5'-GGAUCAGGUGUUCAAACUGAU-3' | (SEQ ID NO: 2589) |
| CKAP5-4348 21 nt Target: | 5'-AUCAGGUGUUCAAACUGAUUG-3' | (SEQ ID NO: 2590) |
| CKAP5-4350 21 nt Target: | 5'-CAGGUGUUCAAACUGAUUGGA-3' | (SEQ ID NO: 2591) |
| CKAP5-4352 21 nt Target: | 5'-GGUGUUCAAACUGAUUGGAAA-3' | (SEQ ID NO: 2592) |
| CKAP5-4354 21 nt Target: | 5'-UGUUCAAACUGAUUGGAAAUC-3' | (SEQ ID NO: 2593) |
| CKAP5-4356 21 nt Target: | 5'-UUCAAACUGAUUGGAAAUCUU-3' | (SEQ ID NO: 2594) |
| CKAP5-4358 21 nt Target: | 5'-CAAACUGAUUGGAAAUCUUUC-3' | (SEQ ID NO: 2595) |
| CKAP5-4360 21 nt Target: | 5'-AACUGAUUGGAAAUCUUUCUG-3' | (SEQ ID NO: 2596) |
| CKAP5-4411 21 nt Target: | 5'-UUAAGCGGUCAGCAAAGAGAC-3' | (SEQ ID NO: 2597) |
| CKAP5-4413 21 nt Target: | 5'-AAGCGGUCAGCAAAGAGACCC-3' | (SEQ ID NO: 2598) |
| CKAP5-4415 21 nt Target: | 5'-GCGGUCAGCAAAGAGACCCUC-3' | (SEQ ID NO: 2599) |
| CKAP5-4417 21 nt Target: | 5'-GGUCAGCAAAGAGACCCUCUG-3' | (SEQ ID NO: 2600) |
| CKAP5-4419 21 nt Target: | 5'-UCAGCAAAGAGACCCUCUGCU-3' | (SEQ ID NO: 2601) |
| CKAP5-4421 21 nt Target: | 5'-AGCAAAGAGACCCUCUGCUGC-3' | (SEQ ID NO: 2602) |
| CKAP5-4423 21 nt Target: | 5'-CAAAGAGACCCUCUGCUGCAC-3' | (SEQ ID NO: 2603) |
| CKAP5-4505 21 nt Target: | 5'-GUUACGCAAGGGACCAGCUGA-3' | (SEQ ID NO: 2604) |
| CKAP5-4507 21 nt Target: | 5'-UACGCAAGGGACCAGCUGAGG-3' | (SEQ ID NO: 2605) |
| CKAP5-4591 21 nt Target: | 5'-UCCGCCGAGAAUUCCAGCUGG-3' | (SEQ ID NO: 2606) |

TABLE 4-continued

DsiRNA Target Sequences (21mers) In CKAP5 mRNA

| | |
|---|---|
| CKAP5-4593 21 nt Target: 5'-CGCCGAGAAUUCCAGCUGGAU-3' | (SEQ ID NO: 2607) |
| CKAP5-4718 21 nt Target: 5'-CAAGAUCCGGGCUGUUUCUCC-3' | (SEQ ID NO: 2608) |
| CKAP5-4720 21 nt Target: 5'-AGAUCCGGGCUGUUUCUCCAC-3' | (SEQ ID NO: 2609) |
| CKAP5-4744 21 nt Target: 5'-UCGAUGACAUGCACAGUAAUA-3' | (SEQ ID NO: 2610) |
| CKAP5-4746 21 nt Target: 5'-GAUGACAUGCACAGUAAUACA-3' | (SEQ ID NO: 2611) |
| CKAP5-4748 21 nt Target: 5'-UGACAUGCACAGUAAUACAGC-3' | (SEQ ID NO: 2612) |
| CKAP5-4750 21 nt Target: 5'-ACAUGCACAGUAAUACAGCAU-3' | (SEQ ID NO: 2613) |
| CKAP5-4752 21 nt Target: 5'-AUGCACAGUAAUACAGCAUCC-3' | (SEQ ID NO: 2614) |
| CKAP5-4754 21 nt Target: 5'-GCACAGUAAUACAGCAUCCAC-3' | (SEQ ID NO: 2615) |
| CKAP5-4756 21 nt Target: 5'-ACAGUAAUACAGCAUCCACAA-3' | (SEQ ID NO: 2616) |
| CKAP5-4758 21 nt Target: 5'-AGUAAUACAGCAUCCACAAUC-3' | (SEQ ID NO: 2617) |
| CKAP5-4760 21 nt Target: 5'-UAAUACAGCAUCCACAAUCAA-3' | (SEQ ID NO: 2618) |
| CKAP5-4762 21 nt Target: 5'-AUACAGCAUCCACAAUCAAUU-3' | (SEQ ID NO: 2619) |
| CKAP5-4764 21 nt Target: 5'-ACAGCAUCCACAAUCAAUUUC-3' | (SEQ ID NO: 2620) |
| CKAP5-4766 21 nt Target: 5'-AGCAUCCACAAUCAAUUUCAU-3' | (SEQ ID NO: 2621) |
| CKAP5-4768 21 nt Target: 5'-CAUCCACAAUCAAUUUCAUUA-3' | (SEQ ID NO: 2622) |
| CKAP5-4770 21 nt Target: 5'-UCCACAAUCAAUUUCAUUAUC-3' | (SEQ ID NO: 2623) |
| CKAP5-4772 21 nt Target: 5'-CACAAUCAAUUUCAUUAUCUC-3' | (SEQ ID NO: 2624) |
| CKAP5-4774 21 nt Target: 5'-CAAUCAAUUUCAUUAUCUCCC-3' | (SEQ ID NO: 2625) |
| CKAP5-4776 21 nt Target: 5'-AUCAAUUUCAUUAUCUCCCAA-3' | (SEQ ID NO: 2626) |
| CKAP5-4778 21 nt Target: 5'-CAAUUUCAUUAUCUCCCAAGU-3' | (SEQ ID NO: 2627) |
| CKAP5-4780 21 nt Target: 5'-AUUUCAUUAUCUCCCAAGUAG-3' | (SEQ ID NO: 2628) |
| CKAP5-4782 21 nt Target: 5'-UUCAUUAUCUCCCAAGUAGCC-3' | (SEQ ID NO: 2629) |
| CKAP5-4784 21 nt Target: 5'-CAUUAUCUCCCAAGUAGCCAG-3' | (SEQ ID NO: 2630) |
| CKAP5-4786 21 nt Target: 5'-UUAUCUCCCAAGUAGCCAGUG-3' | (SEQ ID NO: 2631) |
| CKAP5-4788 21 nt Target: 5'-AUCUCCCAAGUAGCCAGUGGU-3' | (SEQ ID NO: 2632) |
| CKAP5-4790 21 nt Target: 5'-CUCCCAAGUAGCCAGUGGUGA-3' | (SEQ ID NO: 2633) |
| CKAP5-4792 21 nt Target: 5'-CCCAAGUAGCCAGUGGUGACA-3' | (SEQ ID NO: 2634) |
| CKAP5-5041 21 nt Target: 5'-UUGCCCGGGAGGCCUCCACUG-3' | (SEQ ID NO: 2635) |
| CKAP5-5043 21 nt Target: 5'-GCCCGGGAGGCCUCCACUGGA-3' | (SEQ ID NO: 2636) |
| CKAP5-5045 21 nt Target: 5'-CCGGGAGGCCUCCACUGGAGU-3' | (SEQ ID NO: 2637) |
| CKAP5-5047 21 nt Target: 5'-GGGAGGCCUCCACUGGAGUAC-3' | (SEQ ID NO: 2638) |
| CKAP5-5089 21 nt Target: 5'-UCAUCACCUUAAUGCUGGAUU-3' | (SEQ ID NO: 2639) |
| CKAP5-5091 21 nt Target: 5'-AUCACCUUAAUGCUGGAUUCU-3' | (SEQ ID NO: 2640) |
| CKAP5-5093 21 nt Target: 5'-CACCUUAAUGCUGGAUUCUCG-3' | (SEQ ID NO: 2641) |
| CKAP5-5095 21 nt Target: 5'-CCUUAAUGCUGGAUUCUCGGA-3' | (SEQ ID NO: 2642) |
| CKAP5-5097 21 nt Target: 5'-UUAAUGCUGGAUUCUCGGAUU-3' | (SEQ ID NO: 2643) |
| CKAP5-5099 21 nt Target: 5'-AAUGCUGGAUUCUCGGAUUGA-3' | (SEQ ID NO: 2644) |
| CKAP5-5101 21 nt Target: 5'-UGCUGGAUUCUCGGAUUGAAG-3' | (SEQ ID NO: 2645) |

TABLE 4-continued

DsiRNA Target Sequences (21mers) In CKAP5 mRNA

```
CKAP5-5103  21 nt Target: 5'-CUGGAUUCUCGGAUUGAAGAU-3'  (SEQ ID NO: 2646)

CKAP5-5105  21 nt Target: 5'-GGAUUCUCGGAUUGAAGAUCU-3'  (SEQ ID NO: 2647)

CKAP5-5150  21 nt Target: 5'-CUCUGUGAACCUCUUGGUGGU-3'  (SEQ ID NO: 2648)

CKAP5-5152  21 nt Target: 5'-CUGUGAACCUCUUGGUGGUGA-3'  (SEQ ID NO: 2649)

CKAP5-5154  21 nt Target: 5'-GUGAACCUCUUGGUGGUGAAG-3'  (SEQ ID NO: 2650)

CKAP5-5156  21 nt Target: 5'-GAACCUCUUGGUGGUGAAGGU-3'  (SEQ ID NO: 2651)

CKAP5-5230  21 nt Target: 5'-AAGACAGCCUGCUAGCAACAG-3'  (SEQ ID NO: 2652)

CKAP5-5251  21 nt Target: 5'-CCAGUUCUCCCAAAUUCUCAG-3'  (SEQ ID NO: 2653)

CKAP5-5253  21 nt Target: 5'-AGUUCUCCCAAAUUCUCAGAG-3'  (SEQ ID NO: 2654)

CKAP5-5255  21 nt Target: 5'-UUCUCCCAAAUUCUCAGAGCU-3'  (SEQ ID NO: 2655)

CKAP5-5257  21 nt Target: 5'-CUCCCAAAUUCUCAGAGCUUG-3'  (SEQ ID NO: 2656)

CKAP5-5259  21 nt Target: 5'-CCCAAAUUCUCAGAGCUUGUU-3'  (SEQ ID NO: 2657)

CKAP5-5261  21 nt Target: 5'-CAAAUUCUCAGAGCUUGUUAU-3'  (SEQ ID NO: 2658)

CKAP5-5263  21 nt Target: 5'-AAUUCUCAGAGCUUGUUAUGA-3'  (SEQ ID NO: 2659)

CKAP5-5265  21 nt Target: 5'-UUCUCAGAGCUUGUUAUGAAG-3'  (SEQ ID NO: 2660)

CKAP5-5267  21 nt Target: 5'-CUCAGAGCUUGUUAUGAAGUG-3'  (SEQ ID NO: 2661)

CKAP5-5269  21 nt Target: 5'-CAGAGCUUGUUAUGAAGUGUC-3'  (SEQ ID NO: 2662)

CKAP5-5326  21 nt Target: 5'-AUAGCAUUAACCUAGACAGAA-3'  (SEQ ID NO: 2663)

CKAP5-5328  21 nt Target: 5'-AGCAUUAACCUAGACAGAAUU-3'  (SEQ ID NO: 2664)

CKAP5-5330  21 nt Target: 5'-CAUUAACCUAGACAGAAUUCU-3'  (SEQ ID NO: 2665)

CKAP5-5332  21 nt Target: 5'-UUAACCUAGACAGAAUUCUUC-3'  (SEQ ID NO: 2666)

CKAP5-5334  21 nt Target: 5'-AACCUAGACAGAAUUCUUCUG-3'  (SEQ ID NO: 2667)

CKAP5-5336  21 nt Target: 5'-CCUAGACAGAAUUCUUCUGGA-3'  (SEQ ID NO: 2668)

CKAP5-5357  21 nt Target: 5'-UAUCCACAUUUUCAUGAAGGU-3'  (SEQ ID NO: 2669)

CKAP5-5394  21 nt Target: 5'-CUGAAGCAAUGCAAAAGUGAA-3'  (SEQ ID NO: 2670)

CKAP5-5396  21 nt Target: 5'-GAAGCAAUGCAAAAGUGAAUU-3'  (SEQ ID NO: 2671)

CKAP5-5398  21 nt Target: 5'-AGCAAUGCAAAAGUGAAUUC-3'   (SEQ ID NO: 2672)

CKAP5-5551  21 nt Target: 5'-ACAGUAUGGACCAGACUGGGA-3'  (SEQ ID NO: 2673)

CKAP5-5553  21 nt Target: 5'-AGUAUGGACCAGACUGGGAGC-3'  (SEQ ID NO: 2674)

CKAP5-5555  21 nt Target: 5'-UAUGGACCAGACUGGGAGCAA-3'  (SEQ ID NO: 2675)

CKAP5-5557  21 nt Target: 5'-UGGACCAGACUGGGAGCAAGU-3'  (SEQ ID NO: 2676)

CKAP5-5559  21 nt Target: 5'-GACCAGACUGGGAGCAAGUCU-3'  (SEQ ID NO: 2677)

CKAP5-5561  21 nt Target: 5'-CCAGACUGGGAGCAAGUCUGA-3'  (SEQ ID NO: 2678)

CKAP5-5563  21 nt Target: 5'-AGACUGGGAGCAAGUCUGAUA-3'  (SEQ ID NO: 2679)

CKAP5-5565  21 nt Target: 5'-ACUGGGAGCAAGUCUGAUAAG-3'  (SEQ ID NO: 2680)

CKAP5-5567  21 nt Target: 5'-UGGGAGCAAGUCUGAUAAGGA-3'  (SEQ ID NO: 2681)

CKAP5-5569  21 nt Target: 5'-GGAGCAAGUCUGAUAAGGAAA-3'  (SEQ ID NO: 2682)

CKAP5-5571  21 nt Target: 5'-AGCAAGUCUGAUAAGGAAACA-3'  (SEQ ID NO: 2683)

CKAP5-5573  21 nt Target: 5'-CAAGUCUGAUAAGGAAACAGA-3'  (SEQ ID NO: 2684)
```

TABLE 4-continued

DsiRNA Target Sequences (21mers) In CKAP5 mRNA

| | |
|---|---|
| CKAP5-5575 21 nt Target: 5'-AGUCUGAUAAGGAAACAGAAA-3' | (SEQ ID NO: 2685) |
| CKAP5-5577 21 nt Target: 5'-UCUGAUAAGGAAACAGAAAAG-3' | (SEQ ID NO: 2686) |
| CKAP5-5579 21 nt Target: 5'-UGAUAAGGAAACAGAAAAGGG-3' | (SEQ ID NO: 2687) |
| CKAP5-5581 21 nt Target: 5'-AUAAGGAAACAGAAAAGGGAG-3' | (SEQ ID NO: 2688) |
| CKAP5-5602 21 nt Target: 5'-CAUCUCGAAUAGAUGAAAAAU-3' | (SEQ ID NO: 2689) |
| CKAP5-5604 21 nt Target: 5'-UCUCGAAUAGAUGAAAAAUCA-3' | (SEQ ID NO: 2690) |
| CKAP5-5606 21 nt Target: 5'-UCGAAUAGAUGAAAAAUCAUC-3' | (SEQ ID NO: 2691) |
| CKAP5-5608 21 nt Target: 5'-GAAUAGAUGAAAAAUCAUCAA-3' | (SEQ ID NO: 2692) |
| CKAP5-5610 21 nt Target: 5'-AUAGAUGAAAAAUCAUCAAAG-3' | (SEQ ID NO: 2693) |
| CKAP5-5612 21 nt Target: 5'-AGAUGAAAAAUCAUCAAAGGC-3' | (SEQ ID NO: 2694) |
| CKAP5-5614 21 nt Target: 5'-AUGAAAAAUCAUCAAAGGCCA-3' | (SEQ ID NO: 2695) |
| CKAP5-5616 21 nt Target: 5'-GAAAAAUCAUCAAAGGCCAAA-3' | (SEQ ID NO: 2696) |
| CKAP5-5618 21 nt Target: 5'-AAAAUCAUCAAAGGCCAAAGU-3' | (SEQ ID NO: 2697) |
| CKAP5-5639 21 nt Target: 5'-GAAUGAUUUCUUAGCUGAGAU-3' | (SEQ ID NO: 2698) |
| CKAP5-5641 21 nt Target: 5'-AUGAUUUCUUAGCUGAGAUUU-3' | (SEQ ID NO: 2699) |
| CKAP5-5643 21 nt Target: 5'-GAUUUCUUAGCUGAGAUUUUU-3' | (SEQ ID NO: 2700) |
| CKAP5-5645 21 nt Target: 5'-UUUCUUAGCUGAGAUUUUUAA-3' | (SEQ ID NO: 2701) |
| CKAP5-5647 21 nt Target: 5'-UCUUAGCUGAGAUUUUUAAGA-3' | (SEQ ID NO: 2702) |
| CKAP5-5649 21 nt Target: 5'-UUAGCUGAGAUUUUUAAGAAG-3' | (SEQ ID NO: 2703) |
| CKAP5-5651 21 nt Target: 5'-AGCUGAGAUUUUUAAGAAGAU-3' | (SEQ ID NO: 2704) |
| CKAP5-5653 21 nt Target: 5'-CUGAGAUUUUUAAGAAGAUUG-3' | (SEQ ID NO: 2705) |
| CKAP5-5655 21 nt Target: 5'-GAGAUUUUUAAGAAGAUUGGC-3' | (SEQ ID NO: 2706) |
| CKAP5-5657 21 nt Target: 5'-GAUUUUUAAGAAGAUUGGCUC-3' | (SEQ ID NO: 2707) |
| CKAP5-5699 21 nt Target: 5'-ACUAGCAGAGUUAUAUGAAUA-3' | (SEQ ID NO: 2708) |
| CKAP5-5701 21 nt Target: 5'-UAGCAGAGUUAUAUGAAUAUA-3' | (SEQ ID NO: 2709) |
| CKAP5-5703 21 nt Target: 5'-GCAGAGUUAUAUGAAUAUAAG-3' | (SEQ ID NO: 2710) |
| CKAP5-5705 21 nt Target: 5'-AGAGUUAUAUGAAUAUAAGAA-3' | (SEQ ID NO: 2711) |
| CKAP5-5707 21 nt Target: 5'-AGUUAUAUGAAUAUAAGAAGA-3' | (SEQ ID NO: 2712) |
| CKAP5-5709 21 nt Target: 5'-UUAUAUGAAUAUAAGAAGAAA-3' | (SEQ ID NO: 2713) |
| CKAP5-5711 21 nt Target: 5'-AUAUGAAUAUAAGAAGAAAUA-3' | (SEQ ID NO: 2714) |
| CKAP5-5739 21 nt Target: 5'-GCUGACAUUGAACCAUUUCUG-3' | (SEQ ID NO: 2715) |
| CKAP5-5741 21 nt Target: 5'-UGACAUUGAACCAUUUCUGAA-3' | (SEQ ID NO: 2716) |
| CKAP5-5743 21 nt Target: 5'-ACAUUGAACCAUUUCUGAAAA-3' | (SEQ ID NO: 2717) |
| CKAP5-5745 21 nt Target: 5'-AUUGAACCAUUUCUGAAAAAU-3' | (SEQ ID NO: 2718) |
| CKAP5-5747 21 nt Target: 5'-UGAACCAUUUCUGAAAAAUUC-3' | (SEQ ID NO: 2719) |
| CKAP5-5749 21 nt Target: 5'-AACCAUUUCUGAAAAAUUCCU-3' | (SEQ ID NO: 2720) |
| CKAP5-5794 21 nt Target: 5'-AAAGAGGCCUUCGGGUGAUUG-3' | (SEQ ID NO: 2721) |
| CKAP5-5796 21 nt Target: 5'-AGAGGCCUUCGGGUGAUUGAG-3' | (SEQ ID NO: 2722) |
| CKAP5-5798 21 nt Target: 5'-AGGCCUUCGGGUGAUUGAGAU-3' | (SEQ ID NO: 2723) |

TABLE 4-continued

DsiRNA Target Sequences (21mers) In CKAP5 mRNA

| | |
|---|---|
| CKAP5-5800 21 nt Target: 5'-GCCUUCGGGUGAUUGAGAUGG-3' | (SEQ ID NO: 2724) |
| CKAP5-5802 21 nt Target: 5'-CUUCGGGUGAUUGAGAUGGAG-3' | (SEQ ID NO: 2725) |
| CKAP5-5804 21 nt Target: 5'-UCGGGUGAUUGAGAUGGAGAG-3' | (SEQ ID NO: 2726) |
| CKAP5-5944 21 nt Target: 5'-GGCCAUCUGUCUACUUGGAAA-3' | (SEQ ID NO: 2727) |
| CKAP5-5946 21 nt Target: 5'-CCAUCUGUCUACUUGGAAAGG-3' | (SEQ ID NO: 2728) |
| CKAP5-5948 21 nt Target: 5'-AUCUGUCUACUUGGAAAGGCU-3' | (SEQ ID NO: 2729) |
| CKAP5-5950 21 nt Target: 5'-CUGUCUACUUGGAAAGGCUAA-3' | (SEQ ID NO: 2730) |
| CKAP5-6026 21 nt Target: 5'-UUUGACCUCUUUGCUCUCCAA-3' | (SEQ ID NO: 2731) |
| CKAP5-6028 21 nt Target: 5'-UGACCUCUUUGCUCUCCAAAC-3' | (SEQ ID NO: 2732) |
| CKAP5-6030 21 nt Target: 5'-ACCUCUUUGCUCUCCAAACCA-3' | (SEQ ID NO: 2733) |
| CKAP5-6032 21 nt Target: 5'-CUCUUUGCUCUCCAAACCAGC-3' | (SEQ ID NO: 2734) |
| CKAP5-6173 21 nt Target: 5'-UGUGACCUCCUCCUCCUCCAC-3' | (SEQ ID NO: 2735) |
| CKAP5-6217 21 nt Target: 5'-AAAGACUGGAGAGAAUAAAGA-3' | (SEQ ID NO: 2736) |
| CKAP5-6219 21 nt Target: 5'-AGACUGGAGAGAAUAAAGAGC-3' | (SEQ ID NO: 2737) |
| CKAP5-6221 21 nt Target: 5'-ACUGGAGAGAAUAAAGAGCAG-3' | (SEQ ID NO: 2738) |
| CKAP5-6223 21 nt Target: 5'-UGGAGAGAAUAAAGAGCAGUC-3' | (SEQ ID NO: 2739) |
| CKAP5-6225 21 nt Target: 5'-GAGAGAAUAAAGAGCAGUCGC-3' | (SEQ ID NO: 2740) |
| CKAP5-6227 21 nt Target: 5'-GAGAAUAAAGAGCAGUCGCAA-3' | (SEQ ID NO: 2741) |
| CKAP5-6229 21 nt Target: 5'-GAAUAAAGAGCAGUCGCAAAU-3' | (SEQ ID NO: 2742) |
| CKAP5-6231 21 nt Target: 5'-AUAAAGAGCAGUCGCAAAUGA-3' | (SEQ ID NO: 2743) |
| CKAP5-6233 21 nt Target: 5'-AAAGAGCAGUCGCAAAUGAAG-3' | (SEQ ID NO: 2744) |
| CKAP5-6342 21 nt Target: 5'-ACAAACUGGUUGUAUGUAUCA-3' | (SEQ ID NO: 2745) |
| CKAP5-6544 21 nt Target: 5'-UGCUCAUUUGUAAAAUUGUCC-3' | (SEQ ID NO: 2746) |
| CKAP5-6546 21 nt Target: 5'-CUCAUUUGUAAAAUUGUCCUA-3' | (SEQ ID NO: 2747) |
| CKAP5-6548 21 nt Target: 5'-CAUUUGUAAAAUUGUCCUAAU-3' | (SEQ ID NO: 2748) |
| CKAP5-6656 21 nt Target: 5'-UCACUGUAUUCUGUAUGAAUG-3' | (SEQ ID NO: 2749) |
| CKAP5-6658 21 nt Target: 5'-ACUGUAUUCUGUAUGAAUGCA-3' | (SEQ ID NO: 2750) |
| CKAP5-6660 21 nt Target: 5'-UGUAUUCUGUAUGAAUGCAUG-3' | (SEQ ID NO: 2751) |
| CKAP5-6662 21 nt Target: 5'-UAUUCUGUAUGAAUGCAUGGC-3' | (SEQ ID NO: 2752) |
| CKAP5-6664 21 nt Target: 5'-UUCUGUAUGAAUGCAUGGCAU-3' | (SEQ ID NO: 2753) |
| CKAP5-6666 21 nt Target: 5'-CUGUAUGAAUGCAUGGCAUGA-3' | (SEQ ID NO: 2754) |
| CKAP5-6704 21 nt Target: 5'-UCUUUUAUAAAUAAAGUUUGC-3' | (SEQ ID NO: 2755) |
| CKAP5-6706 21 nt Target: 5'-UUUUAUAAAUAAAGUUUGCAU-3' | (SEQ ID NO: 2756) |
| CKAP5-6708 21 nt Target: 5'-UUAUAAAUAAAGUUUGCAUUA-3' | (SEQ ID NO: 2757) |
| CKAP5-6710 21 nt Target: 5'-AUAAAUAAAGUUUGCAUUAAC-3' | (SEQ ID NO: 2758) |
| CKAP5-6712 21 nt Target: 5'-AAAUAAAGUUUGCAUUAACUA-3' | (SEQ ID NO: 2759) |
| CKAP5-6714 21 nt Target: 5'-AUAAAGUUUGCAUUAACUAUA-3' | (SEQ ID NO: 2760) |
| CKAP5-106 21 nt Target: 5'-CCCAGCUGAGGAAAUACUCUU-3' | (SEQ ID NO: 2761) |
| CKAP5-172 21 nt Target: 5'-GGUUGAAACUGCCAGUUGAUC-3' | (SEQ ID NO: 2762) |

TABLE 4-continued

DsiRNA Target Sequences (21mers) In CKAP5 mRNA

| | | |
|---|---|---|
| CKAP5-180 21 nt Target: | 5'-CUGCCAGUUGAUCAGAAAUGU-3' | (SEQ ID NO: 2763) |
| CKAP5-213 21 nt Target: | 5'-UGGAAAGCAAGGUUAAGUGGG-3' | (SEQ ID NO: 2764) |
| CKAP5-281 21 nt Target: | 5'-CCCAGAGUGGUCCAAAUUUUU-3' | (SEQ ID NO: 2765) |
| CKAP5-337 21 nt Target: | 5'-CAGUGGUUCAAUUGAAAGGAU-3' | (SEQ ID NO: 2766) |
| CKAP5-353 21 nt Target: | 5'-AGGAUUAGAAGCUGCACUUGU-3' | (SEQ ID NO: 2767) |
| CKAP5-362 21 nt Target: | 5'-AGCUGCACUUGUUUAUGUUGA-3' | (SEQ ID NO: 2768) |
| CKAP5-395 21 nt Target: | 5'-AGCAGGAAAAACCACAGGAGA-3' | (SEQ ID NO: 2769) |
| CKAP5-422 21 nt Target: | 5'-GUCAGGUGUUGUAAGUAAGGU-3' | (SEQ ID NO: 2770) |
| CKAP5-427 21 nt Target: | 5'-GUGUUGUAAGUAAGGUGUUCA-3' | (SEQ ID NO: 2771) |
| CKAP5-443 21 nt Target: | 5'-GUUCAAUCAACCUAAAGCUAA-3' | (SEQ ID NO: 2772) |
| CKAP5-537 21 nt Target: | 5'-CUCCUGAAAGGCUUGGACAAU-3' | (SEQ ID NO: 2773) |
| CKAP5-637 21 nt Target: | 5'-UUAAGCCAAUUAUCAAAGUGU-3' | (SEQ ID NO: 2774) |
| CKAP5-649 21 nt Target: | 5'-UCAAAGUGUUGCCAAAACUCU-3' | (SEQ ID NO: 2775) |
| CKAP5-659 21 nt Target: | 5'-GCCAAAACUCUUUGAGUCUCG-3' | (SEQ ID NO: 2776) |
| CKAP5-686 21 nt Target: | 5'-GGCUGUUCGAGAUGAAGCCAA-3' | (SEQ ID NO: 2777) |
| CKAP5-755 21 nt Target: | 5'-CCCAUUACAAAAUAUAAACUC-3' | (SEQ ID NO: 2778) |
| CKAP5-761 21 nt Target: | 5'-ACAAAAUAUAAACUCUGUUCA-3' | (SEQ ID NO: 2779) |
| CKAP5-766 21 nt Target: | 5'-AUAUAAACUCUGUUCAGUUGA-3' | (SEQ ID NO: 2780) |
| CKAP5-773 21 nt Target: | 5'-CUCUGUUCAGUUGAAAGAACU-3' | (SEQ ID NO: 2781) |
| CKAP5-928 21 nt Target: | 5'-GUGAUGAGGUGCCACAAAUAG-3' | (SEQ ID NO: 2782) |
| CKAP5-941 21 nt Target: | 5'-ACAAAUAGAUGCUUAUGAGCU-3' | (SEQ ID NO: 2783) |
| CKAP5-953 21 nt Target: | 5'-UUAUGAGCUUUUAGAAGCUGU-3' | (SEQ ID NO: 2784) |
| CKAP5-1046 21 nt Target: | 5'-GGCCCUGGAGUCUGUAGAAGU-3' | (SEQ ID NO: 2785) |
| CKAP5-1051 21 nt Target: | 5'-UGGAGUCUGUAGAAGUACUAA-3' | (SEQ ID NO: 2786) |
| CKAP5-1103 21 nt Target: | 5'-UGCAGAUUUAGUAAAAGCAUU-3' | (SEQ ID NO: 2787) |
| CKAP5-1113 21 nt Target: | 5'-GUAAAAGCAUUAAAGAAGGUU-3' | (SEQ ID NO: 2788) |
| CKAP5-1118 21 nt Target: | 5'-AGCAUUAAAGAAGGUUGUUGG-3' | (SEQ ID NO: 2789) |
| CKAP5-1125 21 nt Target: | 5'-AAGAAGGUUGUUGGAAAGGAC-3' | (SEQ ID NO: 2790) |
| CKAP5-1205 21 nt Target: | 5'-AAGGAAGAAAUUUGGACAAUA-3' | (SEQ ID NO: 2791) |
| CKAP5-1343 21 nt Target: | 5'-CAGUGAGGAUGUUUUAGCAGU-3' | (SEQ ID NO: 2792) |
| CKAP5-1351 21 nt Target: | 5'-AUGUUUUAGCAGUAAUGGAUA-3' | (SEQ ID NO: 2793) |
| CKAP5-1386 21 nt Target: | 5'-AUCAAGCAGCAGACAUCUCUU-3' | (SEQ ID NO: 2794) |
| CKAP5-1395 21 nt Target: | 5'-CAGACAUCUCUUUUUAUUGCA-3' | (SEQ ID NO: 2795) |
| CKAP5-1514 21 nt Target: | 5'-AGUCAGAGAUGCCGCAUUUGA-3' | (SEQ ID NO: 2796) |
| CKAP5-1535 21 nt Target: | 5'-AGCAUUGGGUACUGCUUUGAA-3' | (SEQ ID NO: 2797) |
| CKAP5-1594 21 nt Target: | 5'-AUGUGGACAAACUCAAGCUUG-3' | (SEQ ID NO: 2798) |
| CKAP5-1622 21 nt Target: | 5'-CAAAGAAUGUUCAGAAAAGGU-3' | (SEQ ID NO: 2799) |
| CKAP5-1630 21 nt Target: | 5'-GUUCAGAAAAGGUAGAACUGA-3' | (SEQ ID NO: 2800) |
| CKAP5-1638 21 nt Target: | 5'-AAGGUAGAACUGAUACAUGGU-3' | (SEQ ID NO: 2801) |

TABLE 4-continued

DsiRNA Target Sequences (21mers) In CKAP5 mRNA

| | | |
|---|---|---|
| CKAP5-1847 21 nt Target: | 5'-CGCAGGGAAUACUGGAACCAA-3' | (SEQ ID NO: 2802) |
| CKAP5-1903 21 nt Target: | 5'-AGCCUGAGCUCUCGAUAGAAG-3' | (SEQ ID NO: 2803) |
| CKAP5-1913 21 nt Target: | 5'-CUCGAUAGAAGUAUGUGAAGA-3' | (SEQ ID NO: 2804) |
| CKAP5-1972 21 nt Target: | 5'-UUCUUGACAGCAGUAACUGGA-3' | (SEQ ID NO: 2805) |
| CKAP5-2034 21 nt Target: | 5'-GAGCUAAUGGACCGAACUGAA-3' | (SEQ ID NO: 2806) |
| CKAP5-2068 21 nt Target: | 5'-CAUUAGUGAGGAUGCUAGCCA-3' | (SEQ ID NO: 2807) |
| CKAP5-2083 21 nt Target: | 5'-UAGCCAAGAAACCUGGAUGGA-3' | (SEQ ID NO: 2808) |
| CKAP5-2088 21 nt Target: | 5'-AAGAAACCUGGAUGGAAAGAA-3' | (SEQ ID NO: 2809) |
| CKAP5-2119 21 nt Target: | 5'-AGGUGAUGCAAAUGAAGCUUC-3' | (SEQ ID NO: 2810) |
| CKAP5-2177 21 nt Target: | 5'-CAAAACGUCAGCUCAGGUUGU-3' | (SEQ ID NO: 2811) |
| CKAP5-2246 21 nt Target: | 5'-UGCAAAAGAAGCUAUGACAGC-3' | (SEQ ID NO: 2812) |
| CKAP5-2261 21 nt Target: | 5'-GACAGCAAUAGCCGAAGCCUG-3' | (SEQ ID NO: 2813) |
| CKAP5-2272 21 nt Target: | 5'-CCGAAGCCUGUAUGUUACCAU-3' | (SEQ ID NO: 2814) |
| CKAP5-2339 21 nt Target: | 5'-CAAAAAUCAGUCAGAAACUCU-3' | (SEQ ID NO: 2815) |
| CKAP5-2412 21 nt Target: | 5'-AAAGCUUUCAUUAGCAAUGUG-3' | (SEQ ID NO: 2816) |
| CKAP5-2578 21 nt Target: | 5'-UUGAGAAGAUGCAGGGACAAA-3' | (SEQ ID NO: 2817) |
| CKAP5-2684 21 nt Target: | 5'-GAGCAAUGAUGUCGUUGAUCU-3' | (SEQ ID NO: 2818) |
| CKAP5-2797 21 nt Target: | 5'-AUGAAGUGGCAGGUAUUAUUA-3' | (SEQ ID NO: 2819) |
| CKAP5-2860 21 nt Target: | 5'-CUGCCUUGAAGGGUCGACUCA-3' | (SEQ ID NO: 2820) |
| CKAP5-2865 21 nt Target: | 5'-UUGAAGGGUCGACUCAAUGAU-3' | (SEQ ID NO: 2821) |
| CKAP5-2873 21 nt Target: | 5'-UCGACUCAAUGAUUCAAAUAA-3' | (SEQ ID NO: 2822) |
| CKAP5-2879 21 nt Target: | 5'-CAAUGAUUCAAAUAAAAUCUU-3' | (SEQ ID NO: 2823) |
| CKAP5-2937 21 nt Target: | 5'-GUAGCCAUGGGCCCAAAUAUU-3' | (SEQ ID NO: 2824) |
| CKAP5-2949 21 nt Target: | 5'-CCAAAUAUUAAGCAACAUGUA-3' | (SEQ ID NO: 2825) |
| CKAP5-2997 21 nt Target: | 5'-GUCCUUGGAGACAGCAAGAAC-3' | (SEQ ID NO: 2826) |
| CKAP5-3002 21 nt Target: | 5'-UGGAGACAGCAAGAACAAUGU-3' | (SEQ ID NO: 2827) |
| CKAP5-3285 21 nt Target: | 5'-UUCAUGAUGCAUUUAGGAUAU-3' | (SEQ ID NO: 2828) |
| CKAP5-3367 21 nt Target: | 5'-UGCUAGAGAAAGCCAAAGUUA-3' | (SEQ ID NO: 2829) |
| CKAP5-3571 21 nt Target: | 5'-AAGGGAAGAAGAUGCCAAGCA-3' | (SEQ ID NO: 2830) |
| CKAP5-3650 21 nt Target: | 5'-UGGAAAAGAGCAAAGGAUGAA-3' | (SEQ ID NO: 2831) |
| CKAP5-3655 21 nt Target: | 5'-AAGAGCAAAGGAUGAAAGAUG-3' | (SEQ ID NO: 2832) |
| CKAP5-3716 21 nt Target: | 5'-ACGGGAUGAAUACAUUGAGCA-3' | (SEQ ID NO: 2833) |
| CKAP5-3721 21 nt Target: | 5'-AUGAAUACAUUGAGCAACUAA-3' | (SEQ ID NO: 2834) |
| CKAP5-3890 21 nt Target: | 5'-AAAGUGGCUUACCCUGAGGUU-3' | (SEQ ID NO: 2835) |
| CKAP5-3900 21 nt Target: | 5'-ACCCUGAGGUUUUUGACACC-3' | (SEQ ID NO: 2836) |
| CKAP5-3918 21 nt Target: | 5'-ACCAAUACAAGCGUCCUGAUG-3' | (SEQ ID NO: 2837) |
| CKAP5-3928 21 nt Target: | 5'-GCGUCCUGAUGAAAGCACUAG-3' | (SEQ ID NO: 2838) |
| CKAP5-3934 21 nt Target: | 5'-UGAUGAAAGCACUAGAAUAUU-3' | (SEQ ID NO: 2839) |
| CKAP5-4367 21 nt Target: | 5'-UGGAAAUCUUUCUGAAAAGGA-3' | (SEQ ID NO: 2840) |

TABLE 4-continued

DsiRNA Target Sequences (21mers) In CKAP5 mRNA

CKAP5-4378 21 nt Target: 5'-CUGAAAAGGAUAUGAGCAUGC-3' (SEQ ID NO: 2841)

CKAP5-4487 21 nt Target: 5'-AAGCUCCAAUGCCAACAUGUU-3' (SEQ ID NO: 2842)

CKAP5-4492 21 nt Target: 5'-CCAAUGCCAACAUGUUACGCA-3' (SEQ ID NO: 2843)

CKAP5-4649 21 nt Target: 5'-AUGUGAAAUGCCAGAACUUGU-3' (SEQ ID NO: 2844)

CKAP5-4658 21 nt Target: 5'-GCCAGAACUUGUUCAGCACAA-3' (SEQ ID NO: 2845)

CKAP5-4673 21 nt Target: 5'-GCACAAACUGGAUGACAUUUU-3' (SEQ ID NO: 2846)

CKAP5-4681 21 nt Target: 5'-UGGAUGACAUUUUGAGCCAG-3' (SEQ ID NO: 2847)

CKAP5-4686 21 nt Target: 5'-GACAUUUUGAGCCAGUCCUU-3' (SEQ ID NO: 2848)

CKAP5-4693 21 nt Target: 5'-UUGAGCCAGUCCUUAUUCCUG-3' (SEQ ID NO: 2849)

CKAP5-5057 21 nt Target: 5'-CACUGGAGUACUAAAAGACCU-3' (SEQ ID NO: 2850)

CKAP5-5167 21 nt Target: 5'-UGGUGAAGGUUCUGGAGAAGU-3' (SEQ ID NO: 2851)

CKAP5-5202 21 nt Target: 5'-AUCCUGAGUGCCCUACUUGUU-3' (SEQ ID NO: 2852)

CKAP5-5246 21 nt Target: 5'-AACAGCCAGUUCUCCCAAAUU-3' (SEQ ID NO: 2853)

CKAP5-5271 21 nt Target: 5'-GAGCUUGUUAUGAAGUGUCUC-3' (SEQ ID NO: 2854)

CKAP5-5302 21 nt Target: 5'-UUCGACUGUUGCCUGAUACCA-3' (SEQ ID NO: 2855)

CKAP5-5307 21 nt Target: 5'-CUGUUGCCUGAUACCAUCAAU-3' (SEQ ID NO: 2856)

CKAP5-5312 21 nt Target: 5'-GCCUGAUACCAUCAAUAGCAU-3' (SEQ ID NO: 2857)

CKAP5-5320 21 nt Target: 5'-CCAUCAAUAGCAUUAACCUAG-3' (SEQ ID NO: 2858)

CKAP5-5325 21 nt Target: 5'-AAUAGCAUUAACCUAGACAGA-3' (SEQ ID NO: 2859)

CKAP5-5342 21 nt Target: 5'-CAGAAUUCUUCUGGAUAUCCA-3' (SEQ ID NO: 2860)

CKAP5-5350 21 nt Target: 5'-UUCUGGAUAUCCACAUUUUCA-3' (SEQ ID NO: 2861)

CKAP5-5383 21 nt Target: 5'-CCAAAGAGAAACUGAAGCAAU-3' (SEQ ID NO: 2862)

CKAP5-5388 21 nt Target: 5'-GAGAAACUGAAGCAAUGCAAA-3' (SEQ ID NO: 2863)

CKAP5-5536 21 nt Target: 5'-GCCGGAUGAUGAAGCACAGUA-3' (SEQ ID NO: 2864)

CKAP5-5588 21 nt Target: 5'-AACAGAAAAGGGAGCAUCUCG-3' (SEQ ID NO: 2865)

CKAP5-5594 21 nt Target: 5'-AAAGGGAGCAUCUCGAAUAGA-3' (SEQ ID NO: 2866)

CKAP5-5599 21 nt Target: 5'-GAGCAUCUCGAAUAGAUGAAA-3' (SEQ ID NO: 2867)

CKAP5-5692 21 nt Target: 5'-AAGAGGGACUAGCAGAGUUAU-3' (SEQ ID NO: 2868)

CKAP5-5729 21 nt Target: 5'-AUACUCAGAUGCUGACAUUGA-3' (SEQ ID NO: 2869)

CKAP5-6130 21 nt Target: 5'-AGCAUUCAGACCUGGAUUCUA-3' (SEQ ID NO: 2870)

CKAP5-6136 21 nt Target: 5'-CAGACCUGGAUUCUAACCAGA-3' (SEQ ID NO: 2871)

CKAP5-6141 21 nt Target: 5'-CUGGAUUCUAACCAGACUCAC-3' (SEQ ID NO: 2872)

CKAP5-6193 21 nt Target: 5'-CAGCUAACAUAGACGACUUGA-3' (SEQ ID NO: 2873)

CKAP5-6198 21 nt Target: 5'-AACAUAGACGACUUGAAAAAA-3' (SEQ ID NO: 2874)

CKAP5-6294 21 nt Target: 5'-AACUAGAAGUCCUCAUAGUUU-3' (SEQ ID NO: 2875)

CKAP5-6459 21 nt Target: 5'-UGGAUGAGUUUAGUGUACAGA-3' (SEQ ID NO: 2876)

CKAP5-6517 21 nt Target: 5'-CCCAGAUCCUUUUCUUUUCUU-3' (SEQ ID NO: 2877)

CKAP5-6542 21 nt Target: 5'-AUUGCUCAUUUGUAAAAUUGU-3' (SEQ ID NO: 2878)

TABLE 4-continued

DsiRNA Target Sequences (21mers) In CKAP5 mRNA

CKAP5-6648 21 nt Target: 5'-CUGAAGGGUCACUGUAUUCUG-3' (SEQ ID NO: 2879)

CKAP5-6653 21 nt Target: 5'-GGGUCACUGUAUUCUGUAUGA-3' (SEQ ID NO: 2880)

TABLE 5

Selected Human Anti-CKAP5 "Blunt/Fray" DsiRNAs

5'-UGGAAGCACAAUGGGAGAUGACAGU$_A$$^{AC-3'}$ (SEQ ID NO: 2881)

3'-ACCUUCGUGUUACCCUCUACUGUCA$_C$$_{A-5'}$ (SEQ ID NO: 577)

CKAP5-143 Target: 5'-TGGAAGCACAATGGGAGATGACAGTGA-3' (SEQ ID NO: 1153)

5'-GAAGCACAAUGGGAGAUGACAGUGA$_A$$^{C-3'}$ (SEQ ID NO: 2882)

3'-CUUCGUGUUACCCUCUACUGUCACU$_C$$_{A-5'}$ (SEQ ID NO: 578)

CKAP5-145 Target: 5'-GAAGCACAATGGGAGATGACAGTGAGT-3' (SEQ ID NO: 1154)

5'-AGCACAAUGGGAGAUGACAGUGAGU$_A$$^{A-3'}$ (SEQ ID NO: 2883)

3'-UCGUGUUACCCUCUACUGUCACUCA$_C$$_{C-5'}$ (SEQ ID NO: 579)

CKAP5-147 Target: 5'-AGCACAATGGGAGATGACAGTGAGTGG-3' (SEQ ID NO: 1155)

5'-CACAAUGGGAGAUGACAGUGAGUGG$_C$$^{C-3'}$ (SEQ ID NO: 2884)

3'-GUGUUACCCUCUACUGUCACUCACC$_A$$_{A-5'}$ (SEQ ID NO: 580)

CKAP5-149 Target: 5'-CACAATGGGAGATGACAGTGAGTGGTT-3' (SEQ ID NO: 1156)

5'-CAAUGGGAGAUGACAGUGAGUGGUU$_A$$^{C-3'}$ (SEQ ID NO: 2885)

3'-GUUACCCUCUACUGUCACUCACCAA$_C$$_{A-5'}$ (SEQ ID NO: 581)

CKAP5-151 Target: 5'-CAATGGGAGATGACAGTGAGTGGTTGA-3' (SEQ ID NO: 1157)

5'-AUGGGAGAUGACAGUGAGUGGUUGA$_C$$^{C-3'}$ (SEQ ID NO: 2886)

3'-UACCCUCUACUGUCACUCACCAACU$_U$$_{A-5'}$ (SEQ ID NO: 582)

CKAP5-153 Target: 5'-ATGGGAGATGACAGTGAGTGGTTGAAA-3' (SEQ ID NO: 1158)

5'-GGGAGAUGACAGUGAGUGGUUGAAA$_A$$^{C-3'}$ (SEQ ID NO: 2887)

3'-CCCUCUACUGUCACUCACCAACUUU$_G$$_{A-5'}$ (SEQ ID NO: 583)

CKAP5-155 Target: 5'-GGGAGATGACAGTGAGTGGTTGAAACT-3' (SEQ ID NO: 1159)

TABLE 5-continued

Selected Human Anti-CKAP5 "Blunt/Fray" DsiRNAs

5'-GAGAUGACAGUGAGUGGUUGAAACU$_A$$^{A-3'}$ (SEQ ID NO: 2888)

3'-CUCUACUGUCACUCACCAACUUUGA$_C$$_{G-5'}$ (SEQ ID NO: 584)

CKAP5-157 Target: 5'-GAGATGACAGTGAGTGGTTGAAACTGC-3' (SEQ ID NO: 1160)

5'-GAUGACAGUGAGUGGUUGAAACUGC$^{A}$$^{C-3'}$ (SEQ ID NO: 2889)

3'-CUACUGUCACUCACCAACUUUGACG$_G$$_{A-5'}$ (SEQ ID NO: 585)

CKAP5-159 Target: 5'-GATGACAGTGAGTGGTTGAAACTGCCA-3' (SEQ ID NO: 1161)

5'-CUGAAGAUCUUCCAGAAAAUAAAGG$_C$$^{C-3'}$ (SEQ ID NO: 2890)

3'-GACUUCUAGAAGGUCUUUUAUUUCC$_U$$_{A-5'}$ (SEQ ID NO: 586)

CKAP5-246 Target: 5'-CTGAAGATCTTCCAGAAAATAAAGGAT-3' (SEQ ID NO: 1162)

5'-GAAGAUCUUCCAGAAAAUAAAGGAU$^{A}$$^{C-3'}$ (SEQ ID NO: 2891)

3'-CUUCUAGAAGGUCUUUUAUUUCCUA$_C$$_{A-5'}$ (SEQ ID NO: 587)

CKAP5-248 Target: 5'-GAAGATCTTCCAGAAAATAAAGGATGA-3' (SEQ ID NO: 1163)

5'-AGAUCUUCCAGAAAAUAAAGGAUGA$_C$$^{C-3'}$ (SEQ ID NO: 2892)

3'-UCUAGAAGGUCUUUUAUUUCCUACU$_U$$_{A-5'}$ (SEQ ID NO: 588)

CKAP5-250 Target: 5'-AGATCTTCCAGAAAATAAAGGATGAAA-3' (SEQ ID NO: 1164)

5'-AUCUUCCAGAAAAUAAAGGAUGAAA$_C$$^{A-3'}$ (SEQ ID NO: 2893)

3'-UAGAAGGUCUUUUAUUUCCUACUUU$_U$$_{C-5'}$ (SEQ ID NO: 589)

CKAP5-252 Target: 5'-ATCTTCCAGAAAATAAAGGATGAAAG-3' (SEQ ID NO: 1165)

5'-CUUCCAGAAAAUAAAGGAUGAAAG$_C$$^{A-3'}$ (SEQ ID NO: 2894)

3'-GAAGGUCUUUUAUUUCCUACUUUUC$_U$$_{C-5'}$ (SEQ ID NO: 590)

CKAP5-254 Target: 5'-CTTCCAGAAAATAAAGGATGAAAGAG-3' (SEQ ID NO: 1166)

5'-UCCAGAAAAUAAAGGAUGAAAGAG$_A$$^{A-3'}$ (SEQ ID NO: 2895)

3'-AGGUCUUUUAUUUCCUACUUUUCUC$_G$$_{G-5'}$ (SEQ ID NO: 591)

CKAP5-256 Target: 5'-TCCAGAAAATAAAGGATGAAAGAGCC-3' (SEQ ID NO: 1167)

TABLE 5-continued

Selected Human Anti-CKAP5 "Blunt/Fray" DsiRNAs

5'-CAGAAAAUAAAGGAUGAAAAGAGCC$_A{}^{C\text{-}3'}$ (SEQ ID NO: 2896)

3'-GUCUUUUAUUUCCUACUUUUCUCGG$_G{}_{A\text{-}5'}$ (SEQ ID NO: 592)

CKAP5-258 Target: 5'-CAGAAAATAAAGGATGAAAAGAGCCCA-3' (SEQ ID NO: 1168)

5'-GAAAAUAAAGGAUGAAAAGAGCCCA$_A{}^{C\text{-}3'}$ (SEQ ID NO: 2897)

3'-CUUUUAUUUCCUACUUUUCUCGGGU$_C{}_{A\text{-}5'}$ (SEQ ID NO: 593)

CKAP5-260 Target: 5'-GAAAATAAAGGATGAAAAGAGCCCAGA-3' (SEQ ID NO: 1169)

5'-GAUCAAAAAAUUUGUCACUGAUUCC$_C{}^{C\text{-}3'}$ (SEQ ID NO: 2898)

3'-CUAGUUUUUUAAACAGUGACUAAGG$_U{}_{A\text{-}5'}$ (SEQ ID NO: 594)

CKAP5-308 Target: 5'-GATCAAAAAATTTGTCACTGATTCCAA-3' (SEQ ID NO: 1170)

5'-UCAAAAAAUUUGUCACUGAUUCCAA$_C{}^{A\text{-}3'}$ (SEQ ID NO: 2899)

3'-AGUUUUUUAAACAGUGACUAAGGUU$_A{}_{C\text{-}5'}$ (SEQ ID NO: 595)

CKAP5-310 Target: 5'-TCAAAAAATTTGTCACTGATTCCAATG-3' (SEQ ID NO: 1171)

5'-AAAAAAUUUGUCACUGAUUCCAAUG$_A{}^{C\text{-}3'}$ (SEQ ID NO: 2900)

3'-UUUUUUAAACAGUGACUAAGGUUAC$_G{}_{A\text{-}5'}$ (SEQ ID NO: 596)

CKAP5-312 Target: 5'-AAAAAATTTGTCACTGATTCCAATGCA-3' (SEQ ID NO: 1172)

5'-AAAAUUUGUCACUGAUUCCAAUGCA$_A{}^{C\text{-}3'}$ (SEQ ID NO: 2901)

3'-UUUUAAACAGUGACUAAGGUUACGU$_C{}_{A\text{-}5'}$ (SEQ ID NO: 597)

CKAP5-314 Target: 5'-AAAATTTGTCACTGATTCCAATGCAGT-3' (SEQ ID NO: 1173)

5'-AAUUUGUCACUGAUUCCAAUGCAGU$_A{}^{A\text{-}3'}$ (SEQ ID NO: 2902)

3'-UUAAACAGUGACUAAGGUUACGUCA$_C{}_{C\text{-}5'}$ (SEQ ID NO: 598)

CKAP5-316 Target: 5'-AATTTGTCACTGATTCCAATGCAGTGG-3' (SEQ ID NO: 1174)

5'-UUUGUCACUGAUUCCAAUGCAGUGG$_C{}^{C\text{-}3'}$ (SEQ ID NO: 2903)

3'-AAACAGUGACUAAGGUUACGUCACC$_A{}_{A\text{-}5'}$ (SEQ ID NO: 599)

CKAP5-318 Target: 5'-TTTGTCACTGATTCCAATGCAGTGGTT-3' (SEQ ID NO: 1175)

TABLE 5-continued

Selected Human Anti-CKAP5 "Blunt/Fray" DsiRNAs

5'-UGUCACUGAUUCCAAUGCAGUGGUU$_\text{A}{}^\text{C-3'}$ (SEQ ID NO: 2904)

3'-ACAGUGACUAAGGUUACGUCACCAA$_\text{G}{}_\text{A-5'}$ (SEQ ID NO: 600)

CKAP5-320 Target: 5'-TGTCACTGATTCCAATGCAGTGGTTCA-3' (SEQ ID NO: 1176)

5'-UCACUGAUUCCAAUGCAGUGGUUCA$_\text{C}{}^\text{C-3'}$ (SEQ ID NO: 2905)

3'-AGUGACUAAGGUUACGUCACCAAGU$_\text{U}{}_\text{A-5'}$ (SEQ ID NO: 601)

CKAP5-322 Target: 5'-TCACTGATTCCAATGCAGTGGTTCAAT-3' (SEQ ID NO: 1177)

5'-ACUGAUUCCAAUGCAGUGGUUCAAU$_\text{C}{}^\text{A-3'}$ (SEQ ID NO: 2906)

3'-UGACUAAGGUUACGUCACCAAGUUA$_\text{A}{}_\text{C-5'}$ (SEQ ID NO: 602)

CKAP5-324 Target: 5'-ACTGATTCCAATGCAGTGGTTCAATTG-3' (SEQ ID NO: 1178)

5'-UGAUUCCAAUGCAGUGGUUCAAUUG$_\text{C}{}^\text{C-3'}$ (SEQ ID NO: 2907)

3'-ACUAAGGUUACGUCACCAAGUUAAC$_\text{U}{}_\text{A-5'}$ (SEQ ID NO: 603)

CKAP5-326 Target: 5'-TGATTCCAATGCAGTGGTTCAATTGAA-3' (SEQ ID NO: 1179)

5'-AUUCCAAUGCAGUGGUUCAAUUGAA$_\text{C}{}^\text{A-3'}$ (SEQ ID NO: 2908)

3'-UAAGGUUACGUCACCAAGUUAACUU$_\text{U}{}_\text{C-5'}$ (SEQ ID NO: 604)

CKAP5-328 Target: 5'-ATTCCAATGCAGTGGTTCAATTGAAAG-3' (SEQ ID NO: 1180)

5'-UCCAAUGCAGUGGUUCAAUUGAAAG$_\text{A}{}^\text{C-3'}$ (SEQ ID NO: 2909)

3'-AGGUUACGUCACCAAGUUAACUUUC$_\text{C}{}_\text{A-5'}$ (SEQ ID NO: 605)

CKAP5-330 Target: 5'-TCCAATGCAGTGGTTCAATTGAAAGGA-3' (SEQ ID NO: 1181)

5'-CAAUGCAGUGGUUCAAUUGAAAGGA$_\text{C}{}^\text{C-3'}$ (SEQ ID NO: 2910)

3'-GUUACGUCACCAAGUUAACUUUCCU$_\text{A}{}_\text{A-5'}$ (SEQ ID NO: 606)

CKAP5-332 Target: 5'-CAATGCAGTGGTTCAATTGAAAGGATT-3' (SEQ ID NO: 1182)

5'-AUGCAGUGGUUCAAUUGAAAGGAUU$_\text{C}{}^\text{A-3'}$ (SEQ ID NO: 2911)

3'-UACGUCACCAAGUUAACUUUCCUAA$_\text{U}{}_\text{C-5'}$ (SEQ ID NO: 607)

CKAP5-334 Target: 5'-ATGCAGTGGTTCAATTGAAAGGATTAG-3' (SEQ ID NO: 1183)

TABLE 5-continued

Selected Human Anti-CKAP5 "Blunt/Fray" DsiRNAs

5'-GCAGUGGUUCAAUUGAAAGGAUUAG$_C{}^{C-3'}$ (SEQ ID NO: 2912)

3'-CGUCACCAAGUUAACUUUCCUAAUC$_U{}_{A-5'}$ (SEQ ID NO: 608)

CKAP5-336 Target: 5'-GCAGTGGTTCAATTGAAAGGATTAGAA-3' (SEQ ID NO: 1184)

5'-CCAAGAUCAUAGUGGCCUGUAUAGA$_A{}^{C-3'}$ (SEQ ID NO: 2913)

3'-GGUUCUAGUAUCACCGGACAUAUCU$_C{}_{A-5'}$ (SEQ ID NO: 609)

CKAP5-565 Target: 5'-CCAAGATCATAGTGGCCTGTATAGAGA-3' (SEQ ID NO: 1185)

5'-AAGAUCAUAGUGGCCUGUAUAGAGA$_A{}^{C-3'}$ (SEQ ID NO: 2914)

3'-UUCUAGUAUCACCGGACAUAUCUCU$_G{}_{A-5'}$ (SEQ ID NO: 610)

CKAP5-567 Target: 5'-AAGATCATAGTGGCCTGTATAGAGACA-3' (SEQ ID NO: 1186)

5'-GAUCAUAGUGGCCUGUAUAGAGACA$_A{}^{C-3'}$ (SEQ ID NO: 2915)

3'-CUAGUAUCACCGGACAUAUCUCUGU$_G{}_{A-5'}$ (SEQ ID NO: 611)

CKAP5-569 Target: 5'-GATCATAGTGGCCTGTATAGAGACACT-3' (SEQ ID NO: 1187)

5'-GACACUGAGGAAAGCCUUAAGUGAA$_C{}^{C-3'}$ (SEQ ID NO: 2916)

3'-CUGUGACUCCUUUCGGAAUUCACUU$_A{}_{A-5'}$ (SEQ ID NO: 612)

CKAP5-590 Target: 5'-GACACTGAGGAAAGCCTTAAGTGAATT-3' (SEQ ID NO: 1188)

5'-CACUGAGGAAAGCCUUAAGUGAAUU$_C{}^{A-3'}$ (SEQ ID NO: 2917)

3'-GUGACUCCUUUCGGAAUUCACUUAA$_A{}_{C-5'}$ (SEQ ID NO: 613)

CKAP5-592 Target: 5'-CACTGAGGAAAGCCTTAAGTGAATTTG-3' (SEQ ID NO: 1189)

5'-CUGAGGAAAGCCUUAAGUGAAUUUG$_A{}^{C-3'}$ (SEQ ID NO: 2918)

3'-GACUCCUUUCGGAAUUCACUUAAAC$_C{}_{A-5'}$ (SEQ ID NO: 614)

CKAP5-594 Target: 5'-CTGAGGAAAGCCTTAAGTGAATTTGGT-3' (SEQ ID NO: 1190)

5'-GAGGAAAGCCUUAAGUGAAUUUGGU$_C{}^{A-3'}$ (SEQ ID NO: 2919)

3'-CUCCUUUCGGAAUUCACUUAAACCA$_A{}_{G-5'}$ (SEQ ID NO: 615)

CKAP5-596 Target: 5'-GAGGAAAGCCTTAAGTGAATTTGGTTC-3' (SEQ ID NO: 1191)

TABLE 5-continued

Selected Human Anti-CKAP5 "Blunt/Fray" DsiRNAs

5'-GGAAAGCCUUAAGUGAAUUUGGUUC$_A^{C-3'}$C  (SEQ ID NO: 2920)

3'-CCUUUCGGAAUUCACUUAAACCAAG$_{A-5'}^G$  (SEQ ID NO: 616)

CKAP5-598 Target: 5'-GGAAAGCCTTAAGTGAATTTGGTTCCA-3' (SEQ ID NO: 1192)

5'-AAAGCCUUAAGUGAAUUUGGUUCCA$_C^{C-3'}$C  (SEQ ID NO: 2921)

3'-UUUCGGAAUUCACUUAAACCAAGGU$_{A-5'}^U$  (SEQ ID NO: 617)

CKAP5-600 Target: 5'-AAAGCCTTAAGTGAATTTGGTTCCAAA-3' (SEQ ID NO: 1193)

5'-AGCCUUAAGUGAAUUUGGUUCCAAA$_C^{C-3'}$C  (SEQ ID NO: 2922)

3'-UCGGAAUUCACUUAAACCAAGGUUU$_{A-5'}^U$  (SEQ ID NO: 618)

CKAP5-602 Target: 5'-AGCCTTAAGTGAATTTGGTTCCAAAAT-3' (SEQ ID NO: 1194)

5'-CCUUAAGUGAAUUUGGUUCCAAAAU$_A^{C-3'}$C  (SEQ ID NO: 2923)

3'-GGAAUUCACUUAAACCAAGGUUUUA$_{A-5'}^G$  (SEQ ID NO: 619)

CKAP5-604 Target: 5'-CCTTAAGTGAATTTGGTTCCAAAATCA-3' (SEQ ID NO: 1195)

5'-UUAAGUGAAUUUGGUUCCAAAAUCA$_C^{A-3'}$  (SEQ ID NO: 2924)

3'-AAUUCACUUAAACCAAGGUUUUAGU$_{G-5'}^A$  (SEQ ID NO: 620)

CKAP5-606 Target: 5'-TTAAGTGAATTTGGTTCCAAAATCATC-3' (SEQ ID NO: 1196)

5'-AAGUGAAUUUGGUUCCAAAAUCAUC$_C^{C-3'}$C  (SEQ ID NO: 2925)

3'-UUCACUUAAACCAAGGUUUUAGUAG$_{A-5'}^A$  (SEQ ID NO: 621)

CKAP5-608 Target: 5'-AAGTGAATTTGGTTCCAAAATCATCTT-3' (SEQ ID NO: 1197)

5'-GUGAAUUUGGUUCCAAAAUCAUCUU$_A^{A-3'}$  (SEQ ID NO: 2926)

3'-CACUUAAACCAAGGUUUUAGUAGAA$_{G-5'}^C$  (SEQ ID NO: 622)

CKAP5-610 Target: 5'-GTGAATTTGGTTCCAAAATCATCTTGC-3' (SEQ ID NO: 1198)

5'-GAAUUUGGUUCCAAAAUCAUCUUGC$_C^{C-3'}$  (SEQ ID NO: 2927)

3'-CUUAAACCAAGGUUUUAGUAGAACG$_{A-5'}^A$  (SEQ ID NO: 623)

CKAP5-612 Target: 5'-GAATTTGGTTCCAAAATCATCTTGCTT-3' (SEQ ID NO: 1199)

TABLE 5-continued

Selected Human Anti-CKAP5 "Blunt/Fray" DsiRNAs

5'-UUCGUUCCCAACAAGAACUAGAAGC$_C$$^{CC-3'}$ (SEQ ID NO: 2928)

3'-AAGCAAGGGUUGUUCUUGAUCUUCG$_A$$_{A-5'}$ (SEQ ID NO: 624)

CKAP5-847 Target: 5'-TTCGTTCCCAACAAGAACTAGAAGCTA-3' (SEQ ID NO: 1200)

5'-CGUUCCCAACAAGAACUAGAAGCUA$_C$$^{CC-3'}$ (SEQ ID NO: 2929)

3'-GCAAGGGUUGUUCUUGAUCUUCGAU$_U$$_{A-5'}$ (SEQ ID NO: 625)

CKAP5-849 Target: 5'-CGTTCCCAACAAGAACTAGAAGCTAAA-3' (SEQ ID NO: 1201)

5'-UUCCCAACAAGAACUAGAAGCUAAA$_C$$^{CC-3'}$ (SEQ ID NO: 2930)

3'-AAGGGUUGUUCUUGAUCUUCGAUUU$_A$$_{A-5'}$ (SEQ ID NO: 626)

CKAP5-851 Target: 5'-TTCCCAACAAGAACTAGAAGCTAAATT-3' (SEQ ID NO: 1202)

5'-CCCAACAAGAACUAGAAGCUAAAUU$_A$$^{A-3'}$ (SEQ ID NO: 2931)

3'-GGGUUGUUCUUGAUCUUCGAUUUAA$_C$$_{C-5'}$ (SEQ ID NO: 627)

CKAP5-853 Target: 5'-CCCAACAAGAACTAGAAGCTAAATTGG-3' (SEQ ID NO: 1203)

5'-CAACAAGAACUAGAAGCUAAAUUGG$_C$$^{C-3'}$ (SEQ ID NO: 2932)

3'-GUUGUUCUUGAUCUUCGAUUUAACC$_U$$_{A-5'}$ (SEQ ID NO: 628)

CKAP5-855 Target: 5'-CAACAAGAACTAGAAGCTAAATTGGAA-3' (SEQ ID NO: 1204)

5'-ACAACAGUCUGCUGGUGGAGAUGCU$_A$$^{C-3'}$ (SEQ ID NO: 2933)

3'-UGUUGUCAGACGACCACCUCUACGA$_C$$_{A-5'}$ (SEQ ID NO: 629)

CKAP5-884 Target: 5'-ACAACAGTCTGCTGGTGGAGATGCTGA-3' (SEQ ID NO: 1205)

5'-AACAGUCUGCUGGUGGAGAUGCUGA$_C$$^{A-3'}$ (SEQ ID NO: 2934)

3'-UUGUCAGACGACCACCUCUACGACU$_U$$_{C-5'}$ (SEQ ID NO: 630)

CKAP5-886 Target: 5'-AACAGTCTGCTGGTGGAGATGCTGAAG-3' (SEQ ID NO: 1206)

5'-AGGUGGUGAUGAUGGUGAUGAGGUG$_A$$^{A-3'}$ (SEQ ID NO: 2935)

3'-UCCACCACUACUACCACUACUCCAC$_G$$_{G-5'}$ (SEQ ID NO: 631)

CKAP5-914 Target: 5'-AGGTGGTGATGATGGTGATGAGGTGCC-3' (SEQ ID NO: 1207)

TABLE 5-continued

Selected Human Anti-CKAP5 "Blunt/Fray" DsiRNAs

5'-GUGGUGAUGAUGGUGAUGAGGUGCC$^{C}{}^{A-3'}$  (SEQ ID NO: 2936)

3'-CACCACUACUACCACUACUCCACGG$_{U}{}_{G-5'}$  (SEQ ID NO: 632)

CKAP5-916 Target: 5'-GTGGTGATGATGGTGATGAGGTGCCAC-3' (SEQ ID NO: 1208)

5'-AAAUCCUUUCCAAACUUCCCAAAGA$^{A}{}^{C-3'}$  (SEQ ID NO: 2937)

3'-UUUAGGAAAGGUUUGAAGGGUUUCU$_{G}{}_{A-5'}$  (SEQ ID NO: 633)

CKAP5-976 Target: 5'-AAATCCTTTCCAAACTTCCCAAAGACT-3' (SEQ ID NO: 1209)

5'-AUCCUUUCCAAACUUCCCAAAGACU$^{C}{}^{C-3'}$  (SEQ ID NO: 2938)

3'-UAGGAAAGGUUUGAAGGGUUUCUGA$_{A}{}_{A-5'}$  (SEQ ID NO: 634)

CKAP5-978 Target: 5'-ATCCTTTCCAAACTTCCCAAAGACTTT-3' (SEQ ID NO: 1210)

5'-CCUUUCCAAACUUCCCAAAGACUUU$^{C}{}^{C-3'}$  (SEQ ID NO: 2939)

3'-GGAAAGGUUUGAAGGGUUUCUGAAA$_{A}{}_{A-5'}$  (SEQ ID NO: 635)

CKAP5-980 Target: 5'-CCTTTCCAAACTTCCCAAAGACTTTTA-3' (SEQ ID NO: 1211)

5'-UUUCCAAACUUCCCAAAGACUUUUA$^{C}{}^{A-3'}$  (SEQ ID NO: 2940)

3'-AAAGGUUUGAAGGGUUUCUGAAAAU$_{A}{}_{C-5'}$  (SEQ ID NO: 636)

CKAP5-982 Target: 5'-TTTCCAAACTTCCCAAAGACTTTTATG-3' (SEQ ID NO: 1212)

5'-UCCAAACUUCCCAAAGACUUUUAUG$^{C}{}^{A-3'}$  (SEQ ID NO: 2941)

3'-AGGUUUGAAGGGUUUCUGAAAAUAC$_{U}{}_{G-5'}$  (SEQ ID NO: 637)

CKAP5-984 Target: 5'-TCCAAACTTCCCAAAGACTTTTATGAC-3' (SEQ ID NO: 1213)

5'-CAAACUUCCCAAAGACUUUUAUGAC$^{C}{}^{C-3'}$  (SEQ ID NO: 2942)

3'-GUUUGAAGGGUUUCUGAAAAUACUG$_{U}{}_{A-5'}$  (SEQ ID NO: 638)

CKAP5-986 Target: 5'-CAAACTTCCCAAAGACTTTTATGACAA-3' (SEQ ID NO: 1214)

5'-AACUUCCCAAAGACUUUUAUGACAA$^{C}{}^{C-3'}$  (SEQ ID NO: 2943)

3'-UUGAAGGGUUUCUGAAAAUACUGUU$_{U}{}_{A-5'}$  (SEQ ID NO: 639)

CKAP5-988 Target: 5'-AACTTCCCAAAGACTTTTATGACAAAA-3' (SEQ ID NO: 1215)

TABLE 5-continued

Selected Human Anti-CKAP5 "Blunt/Fray" DsiRNAs

5'-CUUCCCAAAGACUUUUAUGACAAAA$_C{}^{C-3'}$ (SEQ ID NO: 2944)

3'-GAAGGGUUUCUGAAAAUACUGUUUU$_A{}_{A-5'}$ (SEQ ID NO: 640)

CKAP5-990 Target: 5'-CTTCCCAAAGACTTTTATGACAAAATT-3' (SEQ ID NO: 1216)

5'-UCCCAAAGACUUUUAUGACAAAAUU$_A{}^{C-3'}$ (SEQ ID NO: 2945)

3'-AGGGUUUCUGAAAAUACUGUUUUAA$_C{}_{A-5'}$ (SEQ ID NO: 641)

CKAP5-992 Target: 5'-TCCCAAAGACTTTTATGACAAAATTGA-3' (SEQ ID NO: 1217)

5'-CCAAAGACUUUUAUGACAAAAUUGA$_A{}^{A-3'}$ (SEQ ID NO: 2946)

3'-GGUUUCUGAAAAUACUGUUUUAACU$_C{}_{C-5'}$ (SEQ ID NO: 642)

CKAP5-994 Target: 5'-CCAAAGACTTTTATGACAAAATTGAGG-3' (SEQ ID NO: 1218)

5'-AAAGACUUUUAUGACAAAAUUGAGG$_A{}^{C-3'}$ (SEQ ID NO: 2947)

3'-UUUCUGAAAAUACUGUUUUAACUCC$_G{}_{A-5'}$ (SEQ ID NO: 643)

CKAP5-996 Target: 5'-AAAGACTTTTATGACAAAATTGAGGCA-3' (SEQ ID NO: 1219)

5'-AGACUUUUAUGACAAAAUUGAGGCA$_C{}^{C-3'}$ (SEQ ID NO: 2948)

3'-UCUGAAAAUACUGUUUUAACUCCGU$_U{}_{A-5'}$ (SEQ ID NO: 644)

CKAP5-998 Target: 5'-AGACTTTTATGACAAAATTGAGGCAAA-3' (SEQ ID NO: 1220)

5'-ACUUUUAUGACAAAAUUGAGGCAAA$_C{}^{C-3'}$ (SEQ ID NO: 2949)

3'-UGAAAAUACUGUUUUAACUCCGUUU$_U{}_{A-5'}$ (SEQ ID NO: 645)

CKAP5-1000 Target: 5'-ACTTTTATGACAAAATTGAGGCAAAAA-3' (SEQ ID NO: 1221)

5'-UUUUAUGACAAAAUUGAGGCAAAAA$_C{}^{C-3'}$ (SEQ ID NO: 2950)

3'-AAAAUACUGUUUUAACUCCGUUUUU$_U{}_{A-5'}$ (SEQ ID NO: 646)

CKAP5-1002 Target: 5'-TTTTATGACAAAATTGAGGCAAAAAA-3' (SEQ ID NO: 1222)

5'-UUAUGACAAAAUUGAGGCAAAAAAA$_C{}^{A-3'}$ (SEQ ID NO: 2951)

3'-AAUACUGUUUUAACUCCGUUUUUUU$_A{}_{C-5'}$ (SEQ ID NO: 647)

CKAP5-1004 Target: 5'-TTATGACAAAATTGAGGCAAAAAATG-3' (SEQ ID NO: 1223)

TABLE 5-continued

Selected Human Anti-CKAP5 "Blunt/Fray" DsiRNAs

5'-AAAAUGGCAAGAGAGAAAAGAGGCC$_A{}^{C-3'}$ (SEQ ID NO: 2952)

3'-UUUUACCGUUCUCUCUUUUCUCCGG$_G{}_{A-5'}$ (SEQ ID NO: 648)

CKAP5-1025 Target: 5'-AAAATGGCAAGAGAGAAAAGAGGCCCT-3' (SEQ ID NO: 1224)

5'-GAAGGUUGUUGGAAAGGACACCAAU$_A{}^{C-3'}$ (SEQ ID NO: 2953)

3'-CUUCCAACAACCUUUCCUGUGGUUA$_C{}_{A-5'}$ (SEQ ID NO: 649)

CKAP5-1127 Target: 5'-GAAGGTTGTTGGAAAGGACACCAATGT-3' (SEQ ID NO: 1225)

5'-AGGUUGUUGGAAAGGACACCAAUGU$_A{}^{C-3'}$ (SEQ ID NO: 2954)

3'-UCCAACAACCUUUCCUGUGGUUACA$_G{}_{A-5'}$ (SEQ ID NO: 650)

CKAP5-1129 Target: 5'-AGGTTGTTGGAAAGGACACCAATGTCA-3' (SEQ ID NO: 1226)

5'-GUUGUUGGAAAGGACACCAAUGUCA$_C{}^{A-3'}$ (SEQ ID NO: 2955)

3'-CAACAACCUUUCCUGUGGUUACAGU$_A{}_{C-5'}$ (SEQ ID NO: 651)

CKAP5-1131 Target: 5'-GTTGTTGGAAAGGACACCAATGTCATG-3' (SEQ ID NO: 1227)

5'-UGUUGGAAAGGACACCAAUGUCAUG$_C{}^{C-3'}$ (SEQ ID NO: 2956)

3'-ACAACCUUUCCUGUGGUUACAGUAC$_A{}_{A-5'}$ (SEQ ID NO: 652)

CKAP5-1133 Target: 5'-TGTTGGAAAGGACACCAATGTCATGTT-3' (SEQ ID NO: 1228)

5'-UUGGAAAGGACACCAAUGUCAUGUU$_A{}^{A-3'}$ (SEQ ID NO: 2957)

3'-AACCUUUCCUGUGGUUACAGUACAA$_C{}_{C-5'}$ (SEQ ID NO: 653)

CKAP5-1135 Target: 5'-TTGGAAAGGACACCAATGTCATGTTGG-3' (SEQ ID NO: 1229)

5'-GGAAAGGACACCAAUGUCAUGUUGG$_C{}^{A-3'}$ (SEQ ID NO: 2958)

3'-CCUUUCCUGUGGUUACAGUACAACC$_A{}_{C-5'}$ (SEQ ID NO: 654)

CKAP5-1137 Target: 5'-GGAAAGGACACCAATGTCATGTTGGTG-3' (SEQ ID NO: 1230)

5'-AAAGGACACCAAUGUCAUGUUGGUG$_A{}^{A-3'}$ (SEQ ID NO: 2959)

3'-UUUCCUGUGGUUACAGUACAACCAC$_C{}_{G-5'}$ (SEQ ID NO: 655)

CKAP5-1139 Target: 5'-AAAGGACACCAATGTCATGTTGGTGGC-3' (SEQ ID NO: 1231)

TABLE 5-continued

Selected Human Anti-CKAP5 "Blunt/Fray" DsiRNAs

5'-AGGACACCAAUGUCAUGUUGGUGGC$_C{}^{C-3'}$ (SEQ ID NO: 2960)

3'-UCCUGUGGUUACAGUACAACCACCG$_A{}_{A-5'}$ (SEQ ID NO: 656)

CKAP5-1141 Target: 5'-AGGACACCAATGTCATGTTGGTGGCTT-3' (SEQ ID NO: 1232)

5'-UGGCUUUGGCAGCAAAAUGUCUUAC$_C{}^{A-3'}$ (SEQ ID NO: 2961)

3'-ACCGAAACCGUCGUUUUACAGAAUG$_A{}_{C-5'}$ (SEQ ID NO: 657)

CKAP5-1162 Target: 5'-TGGCTTTGGCAGCAAAATGTCTTACTG-3' (SEQ ID NO: 1233)

5'-GCUUUGGCAGCAAAAUGUCUUACUG$_A{}^{A-3'}$ (SEQ ID NO: 2962)

3'-CGAAACCGUCGUUUUACAGAAUGAC$_C{}_{G-5'}$ (SEQ ID NO: 658)

CKAP5-1164 Target: 5'-GCTTTGGCAGCAAAATGTCTTACTGGC-3' (SEQ ID NO: 1234)

5'-UUUGGCAGCAAAAUGUCUUACUGGC$_A{}^{C-3'}$ (SEQ ID NO: 2963)

3'-AAACCGUCGUUUUACAGAAUGACCG$_G{}_{A-5'}$ (SEQ ID NO: 659)

CKAP5-1166 Target: 5'-TTTGGCAGCAAAATGTCTTACTGGCCT-3' (SEQ ID NO: 1235)

5'-UGGCAGCAAAAUGUCUUACUGGCCU$_A{}^{A-3'}$ (SEQ ID NO: 2964)

3'-ACCGUCGUUUUACAGAAUGACCGGA$_C{}_{C-5'}$ (SEQ ID NO: 660)

CKAP5-1168 Target: 5'-TGGCAGCAAAATGTCTTACTGGCCTGG-3' (SEQ ID NO: 1236)

5'-GCAGCAAAAUGUCUUACUGGCCUGG$_A{}^{C-3'}$ (SEQ ID NO: 2965)

3'-CGUCGUUUUACAGAAUGACCGGACC$_G{}_{A-5'}$ (SEQ ID NO: 661)

CKAP5-1170 Target: 5'-GCAGCAAAATGTCTTACTGGCCTGGCT-3' (SEQ ID NO: 1237)

5'-GAAGAAAUUUGGACAAUAUGCAGGA$_A{}^{C-3'}$ (SEQ ID NO: 2966)

3'-CUUCUUUAAACCUGUUAUACGUCCU$_G{}_{A-5'}$ (SEQ ID NO: 662)

CKAP5-1208 Target: 5'-GAAGAAATTTGGACAATATGCAGGACA-3' (SEQ ID NO: 1238)

5'-AGAAAUUUGGACAAUAUGCAGGACA$_C{}^{A-3'}$ (SEQ ID NO: 2967)

3'-UCUUUAAACCUGUUAUACGUCCUGU$_A{}_{C-5'}$ (SEQ ID NO: 663)

CKAP5-1210 Target: 5'-AGAAATTTGGACAATATGCAGGACATG-3' (SEQ ID NO: 1239)

TABLE 5-continued

Selected Human Anti-CKAP5 "Blunt/Fray" DsiRNAs

5'-AAAUUUGGACAAUAUGCAGGACAUG$_C$$^{C-3'}_C$ (SEQ ID NO: 2968)

3'-UUUAAACCUGUUAUACGUCCUGUAC$_A$$_{A-5'}$ (SEQ ID NO: 664)

CKAP5-1212 Target: 5'-AAATTTGGACAATATGCAGGACATGTT-3' (SEQ ID NO: 1240)

5'-AUUUGGACAAUAUGCAGGACAUGUU$_A$$^{C-3'}$ (SEQ ID NO: 2969)

3'-UAAACCUGUUAUACGUCCUGUACAA$_C$$_{A-5'}$ (SEQ ID NO: 665)

CKAP5-1214 Target: 5'-ATTTGGACAATATGCAGGACATGTTGT-3' (SEQ ID NO: 1241)

5'-UUGGACAAUAUGCAGGACAUGUUGU$_A$$^{A-3'}$ (SEQ ID NO: 2970)

3'-AACCUGUUAUACGUCCUGUACAACA$_C$$_{G-5'}$ (SEQ ID NO: 666)

CKAP5-1216 Target: 5'-TTGGACAATATGCAGGACATGTTGTGC-3' (SEQ ID NO: 1242)

5'-GGACAAUAUGCAGGACAUGUUGUGC$_A$$^{C-3'}$ (SEQ ID NO: 2971)

3'-CCUGUUAUACGUCCUGUACAACACG$_G$$_{A-5'}$ (SEQ ID NO: 667)

CKAP5-1218 Target: 5'-GGACAATATGCAGGACATGTTGTGCCA-3' (SEQ ID NO: 1243)

5'-ACAAUAUGCAGGACAUGUUGUGCCA$_C$$^{A-3'}$ (SEQ ID NO: 2972)

3'-UGUUAUACGUCCUGUACAACACGGU$_U$$_{G-5'}$ (SEQ ID NO: 668)

CKAP5-1220 Target: 5'-ACAATATGCAGGACATGTTGTGCCAAC-3' (SEQ ID NO: 1244)

5'-AAUAUGCAGGACAUGUUGUGCCAAC$_A$$^{C-3'}$ (SEQ ID NO: 2973)

3'-UUAUACGUCCUGUACAACACGGUUG$_G$$_{A-5'}$ (SEQ ID NO: 669)

CKAP5-1222 Target: 5'-AATATGCAGGACATGTTGTGCCAACCA-3' (SEQ ID NO: 1245)

5'-UAUGCAGGACAUGUUGUGCCAACCA$_C$$^{A-3'}$ (SEQ ID NO: 2974)

3'-AUACGUCCUGUACAACACGGUUGGU$_A$$_{G-5'}$ (SEQ ID NO: 670)

CKAP5-1224 Target: 5'-TATGCAGGACATGTTGTGCCAACCATC-3' (SEQ ID NO: 1246)

5'-UGCAGGACAUGUUGUGCCAACCAUC$_C$$^{C-3'}$ (SEQ ID NO: 2975)

3'-ACGUCCUGUACAACACGGUUGGUAG$_A$$_{A-5'}$ (SEQ ID NO: 671)

CKAP5-1226 Target: 5'-TGCAGGACATGTTGTGCCAACCATCTT-3' (SEQ ID NO: 1247)

TABLE 5-continued

Selected Human Anti-CKAP5 "Blunt/Fray" DsiRNAs

5'-ACCUCAAGUGGUACAAGCCCUGCAG$_A{}^{C-3'}$ (SEQ ID NO: 2976)

3'-UGGAGUUCACCAUGUUCGGGACGUC$_{C_{A-5'}}$ (SEQ ID NO: 672)

CKAP5-1274 Target: 5'-ACCTCAAGTGGTACAAGCCCTGCAGGA-3' (SEQ ID NO: 1248)

5'-CUCAAGUGGUACAAGCCCUGCAGGA$_A{}^{A-3'}$ (SEQ ID NO: 2977)

3'-GAGUUCACCAUGUUCGGGACGUCCU$_{C_{C-5'}}$ (SEQ ID NO: 673)

CKAP5-1276 Target: 5'-CTCAAGTGGTACAAGCCCTGCAGGAGG-3' (SEQ ID NO: 1249)

5'-CAAGUGGUACAAGCCCUGCAGGAGG$_A{}^{C-3'}$ (SEQ ID NO: 2978)

3'-GUUCACCAUGUUCGGGACGUCCUCC$_{G_{A-5'}}$ (SEQ ID NO: 674)

CKAP5-1278 Target: 5'-CAAGTGGTACAAGCCCTGCAGGAGGCA-3' (SEQ ID NO: 1250)

5'-AGUGGUACAAGCCCUGCAGGAGGCA$_C{}^{C-3'}$ (SEQ ID NO: 2979)

3'-UCACCAUGUUCGGGACGUCCUCCGU$_{U_{A-5'}}$ (SEQ ID NO: 675)

CKAP5-1280 Target: 5'-AGTGGTACAAGCCCTGCAGGAGGCAAT-3' (SEQ ID NO: 1251)

5'-UGGUACAAGCCCUGCAGGAGGCAAU$_C{}^{A-3'}$ (SEQ ID NO: 2980)

3'-ACCAUGUUCGGGACGUCCUCCGUUA$_{A_{C-5'}}$ (SEQ ID NO: 676)

CKAP5-1282 Target: 5'-TGGTACAAGCCCTGCAGGAGGCAATTG-3' (SEQ ID NO: 1252)

5'-GUACAAGCCCUGCAGGAGGCAAUUG$_C{}^{C-3'}$ (SEQ ID NO: 2981)

3'-CAUGUUCGGGACGUCCUCCGUUAAC$_{U_{A-5'}}$ (SEQ ID NO: 677)

CKAP5-1284 Target: 5'-GTACAAGCCCTGCAGGAGGCAATTGAT-3' (SEQ ID NO: 1253)

5'-ACAAGCCCUGCAGGAGGCAAUUGAU$_A{}^{A-3'}$ (SEQ ID NO: 2982)

3'-UGUUCGGGACGUCCUCCGUUAACUA$_{C_{G-5'}}$ (SEQ ID NO: 678)

CKAP5-1286 Target: 5'-ACAAGCCCTGCAGGAGGCAATTGATGC-3' (SEQ ID NO: 1254)

5'-AAGCCCUGCAGGAGGCAAUUGAUGC$_C{}^{C-3'}$ (SEQ ID NO: 2983)

3'-UUCGGGACGUCCUCCGUUAACUACG$_{U_{A-5'}}$ (SEQ ID NO: 679)

CKAP5-1288 Target: 5'-AAGCCCTGCAGGAGGCAATTGATGCAA-3' (SEQ ID NO: 1255)

TABLE 5-continued

Selected Human Anti-CKAP5 "Blunt/Fray" DsiRNAs

5'-GCCCUGCAGGAGGCAAUUGAUGCAA$_C{}^{A-3'}$ (SEQ ID NO: 2984)

3'-CGGGACGUCCUCCGUUAACUACGUU$_{A_{G-5'}}$ (SEQ ID NO: 680)

CKAP5-1290 Target: 5'-GCCCTGCAGGAGGCAATTGATGCAATC-3' (SEQ ID NO: 1256)

5'-CCUGCAGGAGGCAAUUGAUGCAAUC$_C{}^{C-3'}$ (SEQ ID NO: 2985)

3'-GGACGUCCUCCGUUAACUACGUUAG$_{A_{A-5'}}$ (SEQ ID NO: 681)

CKAP5-1292 Target: 5'-CCTGCAGGAGGCAATTGATGCAATCTT-3' (SEQ ID NO: 1257)

5'-UGCAGGAGGCAAUUGAUGCAAUCUU$_A{}^{A-3'}$ (SEQ ID NO: 2986)

3'-ACGUCCUCCGUUAACUACGUUAGAA$_{G_{G-5'}}$ (SEQ ID NO: 682)

CKAP5-1294 Target: 5'-TGCAGGAGGCAATTGATGCAATCTTCC-3' (SEQ ID NO: 1258)

5'-CAGGAGGCAAUUGAUGCAAUCUUCC$_C{}^{C-3'}$ (SEQ ID NO: 2987)

3'-GUCCUCCGUUAACUACGUUAGAAGG$_{A_{A-5'}}$ (SEQ ID NO: 683)

CKAP5-1296 Target: 5'-CAGGAGGCAATTGATGCAATCTTCCTT-3' (SEQ ID NO: 1259)

5'-GGAGGCAAUUGAUGCAAUCUUCCUU$_C{}^{A-3'}$ (SEQ ID NO: 2988)

3'-CCUCCGUUAACUACGUUAGAAGGAA$_{U_{G-5'}}$ (SEQ ID NO: 684)

CKAP5-1298 Target: 5'-GGAGGCAATTGATGCAATCTTCCTTAC-3' (SEQ ID NO: 1260)

5'-AGGCAAUUGAUGCAAUCUUCCUUAC$_C{}^{C-3'}$ (SEQ ID NO: 2989)

3'-UCCGUUAACUACGUUAGAAGGAAUG$_{A_{A-5'}}$ (SEQ ID NO: 685)

CKAP5-1300 Target: 5'-AGGCAATTGATGCAATCTTCCTTACTA-3' (SEQ ID NO: 1261)

5'-UUACUACCACACUACAGAACAUCAG$_C{}^{A-3'}$ (SEQ ID NO: 2990)

3'-AAUGAUGGUGUGAUGUCUUGUAGUC$_{A_{C-5'}}$ (SEQ ID NO: 686)

CKAP5-1321 Target: 5'-TTACTACCACACTACAGAACATCAGTG-3' (SEQ ID NO: 1262)

5'-ACUACCACACUACAGAACAUCAGUG$_C{}^{A-3'}$ (SEQ ID NO: 2991)

3'-UGAUGGUGUGAUGUCUUGUAGUCAC$_{U_{C-5'}}$ (SEQ ID NO: 687)

CKAP5-1323 Target: 5'-ACTACCACACTACAGAACATCAGTGAG-3' (SEQ ID NO: 1263)

TABLE 5-continued

Selected Human Anti-CKAP5 "Blunt/Fray" DsiRNAs

5'-UACCACACUACAGAACAUCAGUGAG$^{A}$$^{C-3'}$ (SEQ ID NO: 2992)

3'-AUGGUGUGAUGUCUUGUAGUCACUC$_{C}$$_{A-5'}$ (SEQ ID NO: 688)

CKAP5-1325 Target: 5'-TACCACACTACAGAACATCAGTGAGGA-3' (SEQ ID NO: 1264)

5'-CCACACUACAGAACAUCAGUGAGGA$^{C}$$^{A-3'}$ (SEQ ID NO: 2993)

3'-GGUGUGAUGUCUUGUAGUCACUCCU$_{A}$$_{C-5'}$ (SEQ ID NO: 689)

CKAP5-1327 Target: 5'-CCACACTACAGAACATCAGTGAGGATG-3' (SEQ ID NO: 1265)

5'-ACACUACAGAACAUCAGUGAGGAUG$_{C}$$^{C-3'}$ (SEQ ID NO: 2994)

3'-UGUGAUGUCUUGUAGUCACUCCUAC$_{A}$$_{A-5'}$ (SEQ ID NO: 690)

CKAP5-1329 Target: 5'-ACACTACAGAACATCAGTGAGGATGTT-3' (SEQ ID NO: 1266)

5'-ACUACAGAACAUCAGUGAGGAUGUU$_{C}$$^{C-3'}$ (SEQ ID NO: 2995)

3'-UGAUGUCUUGUAGUCACUCCUACAA$_{A}$$_{A-5'}$ (SEQ ID NO: 691)

CKAP5-1331 Target: 5'-ACTACAGAACATCAGTGAGGATGTTTT-3' (SEQ ID NO: 1267)

5'-UACAGAACAUCAGUGAGGAUGUUUU$_{C}$$^{A-3'}$ (SEQ ID NO: 2996)

3'-AUGUCUUGUAGUCACUCCUACAAAA$_{U}$$_{C-5'}$ (SEQ ID NO: 692)

CKAP5-1333 Target: 5'-TACAGAACATCAGTGAGGATGTTTTAG-3' (SEQ ID NO: 1268)

5'-UUUUAGCAGUAAUGGAUAAUAAAAA$_{C}$$^{A-3'}$ (SEQ ID NO: 2997)

3'-AAAAUCGUCAUUACCUAUUAUUUUU$_{A}$$_{G-5'}$ (SEQ ID NO: 693)

CKAP5-1354 Target: 5'-TTTTAGCAGTAATGGATAATAAAAATC-3' (SEQ ID NO: 1269)

5'-UUAGCAGUAAUGGAUAAUAAAAAUC$^{A}$$^{C-3'}$ (SEQ ID NO: 2998)

3'-AAUCGUCAUUACCUAUUAUUUUUAG$_{G}$$_{A-5'}$ (SEQ ID NO: 694)

CKAP5-1356 Target: 5'-TTAGCAGTAATGGATAATAAAAATCCA-3' (SEQ ID NO: 1270)

5'-AGCAGUAAUGGAUAAUAAAAAUCCA$_{C}$$^{A-3'}$ (SEQ ID NO: 2999)

3'-UCGUCAUUACCUAUUAUUUUUAGGU$_{U}$$_{G-5'}$ (SEQ ID NO: 695)

CKAP5-1358 Target: 5'-AGCAGTAATGGATAATAAAAATCCAAC-3' (SEQ ID NO: 1271)

TABLE 5-continued

Selected Human Anti-CKAP5 "Blunt/Fray" DsiRNAs

5'-CAGUAAUGGAUAAUAAAAAUCCAAC$_A$$^{C-3'}$ (SEQ ID NO: 3000)

3'-GUCAUUACCUAUUAUUUUUAGGUUG$_{G_{A-5'}}$ (SEQ ID NO: 696)

CKAP5-1360 Target: 5'-CAGTAATGGATAATAAAAATCCAACCA-3' (SEQ ID NO: 1272)

5'-CAACCAUCAAGCAGCAGACAUCUCU$_C$$^{C-3'}$ (SEQ ID NO: 3001)

3'-GUUGGUAGUUCGUCGUCUGUAGAGA$_{A_{A-5'}}$ (SEQ ID NO: 697)

CKAP5-1381 Target: 5'-CAACCATCAAGCAGCAGACATCTCTTT-3' (SEQ ID NO: 1273)

5'-CACUACUUAAGCACAUCAAUGAUUC$_C$$^{A-3'}$ (SEQ ID NO: 3002)

3'-GUGAUGAAUUCGUGUAGUUACUAAG$_{A_{C-5'}}$ (SEQ ID NO: 698)

CKAP5-1480 Target: 5'-CACTACTTAAGCACATCAATGATTCTG-3' (SEQ ID NO: 1274)

5'-CUACUUAAGCACAUCAAUGAUUCUG$_A$$^{C-3'}$ (SEQ ID NO: 3003)

3'-GAUGAAUUCGUGUAGUUACUAAGAC$_{G_{A-5'}}$ (SEQ ID NO: 699)

CKAP5-1482 Target: 5'-CTACTTAAGCACATCAATGATTCTGCT-3' (SEQ ID NO: 1275)

5'-ACUUAAGCACAUCAAUGAUUCUGCU$_A$$^{A-3'}$ (SEQ ID NO: 3004)

3'-UGAAUUCGUGUAGUUACUAAGACGA$_{G_{G-5'}}$ (SEQ ID NO: 700)

CKAP5-1484 Target: 5'-ACTTAAGCACATCAATGATTCTGCTCC-3' (SEQ ID NO: 1276)

5'-UUAAGCACAUCAAUGAUUCUGCUCC$_C$$^{A-3'}$ (SEQ ID NO: 3005)

3'-AAUUCGUGUAGUUACUAAGACGAGG$_{A_{C-5'}}$ (SEQ ID NO: 701)

CKAP5-1486 Target: 5'-TTAAGCACATCAATGATTCTGCTCCTG-3' (SEQ ID NO: 1277)

5'-AAGCACAUCAAUGAUUCUGCUCCUG$_C$$^{C-3'}$ (SEQ ID NO: 3006)

3'-UUCGUGUAGUUACUAAGACGAGGAC$_{U_{A-5'}}$ (SEQ ID NO: 702)

CKAP5-1488 Target: 5'-AAGCACATCAATGATTCTGCTCCTGAA-3' (SEQ ID NO: 1278)

5'-GCACAUCAAUGAUUCUGCUCCUGAA$_A$$^{C-3'}$ (SEQ ID NO: 3007)

3'-CGUGUAGUUACUAAGACGAGGACUU$_{C_{A-5'}}$ (SEQ ID NO: 703)

CKAP5-1490 Target: 5'-GCACATCAATGATTCTGCTCCTGAAGT-3' (SEQ ID NO: 1279)

TABLE 5-continued

Selected Human Anti-CKAP5 "Blunt/Fray" DsiRNAs

5'-ACAUCAAUGAUUCUGCUCCUGAAGU$_A^{C-3'}$  (SEQ ID NO: 3008)

3'-UGUAGUUACUAAGACGAGGACUUCA$_{G_{A-5'}}$  (SEQ ID NO: 704)

CKAP5-1492 Target: 5'-ACATCAATGATTCTGCTCCTGAAGTCA-3' (SEQ ID NO: 1280)

5'-AUCAAUGAUUCUGCUCCUGAAGUCA$_A^{C-3'}$  (SEQ ID NO: 3009)

3'-UAGUUACUAAGACGAGGACUUCAGU$_{C_{A-5'}}$  (SEQ ID NO: 705)

CKAP5-1494 Target: 5'-ATCAATGATTCTGCTCCTGAAGTCAGA-3' (SEQ ID NO: 1281)

5'-CAAUGAUUCUGCUCCUGAAGUCAGA$_A^{C-3'}$  (SEQ ID NO: 3010)

3'-GUUACUAAGACGAGGACUUCAGUCU$_{C_{A-5'}}$  (SEQ ID NO: 706)

CKAP5-1496 Target: 5'-CAATGATTCTGCTCCTGAAGTCAGAGA-3' (SEQ ID NO: 1282)

5'-AUGAUUCUGCUCCUGAAGUCAGAGA$_C^{A-3'}$  (SEQ ID NO: 3011)

3'-UACUAAGACGAGGACUUCAGUCUCU$_{A_{C-5'}}$  (SEQ ID NO: 707)

CKAP5-1498 Target: 5'-ATGATTCTGCTCCTGAAGTCAGAGATG-3' (SEQ ID NO: 1283)

5'-GAUUCUGCUCCUGAAGUCAGAGAUG$_A^{A-3'}$  (SEQ ID NO: 3012)

3'-CUAAGACGAGGACUUCAGUCUCUAC$_{G_{G-5'}}$  (SEQ ID NO: 708)

CKAP5-1500 Target: 5'-GATTCTGCTCCTGAAGTCAGAGATGCC-3' (SEQ ID NO: 1284)

5'-UUCUGCUCCUGAAGUCAGAGAUGCC$_A^{A-3'}$  (SEQ ID NO: 3013)

3'-AAGACGAGGACUUCAGUCUCUACGG$_{C_{G-5'}}$  (SEQ ID NO: 709)

CKAP5-1502 Target: 5'-TTCTGCTCCTGAAGTCAGAGATGCCGC-3' (SEQ ID NO: 1285)

5'-CUGCUCCUGAAGUCAGAGAUGCCGC$_C^{C-3'}$  (SEQ ID NO: 3014)

3'-GACGAGGACUUCAGUCUCUACGGCG$_{U_{A-5'}}$  (SEQ ID NO: 710)

CKAP5-1504 Target: 5'-CTGCTCCTGAAGTCAGAGATGCCGCAT-3' (SEQ ID NO: 1286)

5'-AAGAUCAAAGAAUGUUCAGAAAAGG$_C^{C-3'}$  (SEQ ID NO: 3015)

3'-UUCUAGUUUCUUACAAGUCUUUUCC$_{A_{A-5'}}$  (SEQ ID NO: 711)

CKAP5-1617 Target: 5'-AAGATCAAAGAATGTTCAGAAAAGGTA-3' (SEQ ID NO: 1287)

TABLE 5-continued

Selected Human Anti-CKAP5 "Blunt/Fray" DsiRNAs

5'-GAUCAAAGAAUGUUCAGAAAAGGUA$_A{}^{C\text{-}3'}$ (SEQ ID NO: 3016)

3'-CUAGUUUCUUACAAGUCUUUUCCAU$_{C_{A\text{-}5'}}$ (SEQ ID NO: 712)

CKAP5-1619 Target: 5'-GATCAAAGAATGTTCAGAAAAGGTAGA-3' (SEQ ID NO: 1288)

5'-GAAACCUGGAUGGAAAGAAACUAAU$_C{}^{C\text{-}3'}$ (SEQ ID NO: 3017)

3'-CUUUGGACCUACCUUUCUUUGAUUA$_{A_{A\text{-}5'}}$ (SEQ ID NO: 713)

CKAP5-2090 Target: 5'-GAAACCTGGATGGAAAGAAACTAATTT-3' (SEQ ID NO: 1289)

5'-AACCUGGAUGGAAAGAAACUAAUUU$_C{}^{A\text{-}3'}$ (SEQ ID NO: 3018)

3'-UUGGACCUACCUUUCUUUGAUUAAA$_{A_{G\text{-}5'}}$ (SEQ ID NO: 714)

CKAP5-2092 Target: 5'-AACCTGGATGGAAAGAAACTAATTTTC-3' (SEQ ID NO: 1290)

5'-CCUGGAUGGAAAGAAACUAAUUUUC$_C{}^{A\text{-}3'}$ (SEQ ID NO: 3019)

3'-GGACCUACCUUUCUUUGAUUAAAAG$_{U_{C\text{-}5'}}$ (SEQ ID NO: 715)

CKAP5-2094 Target: 5'-CCTGGATGGAAAGAAACTAATTTTCAG-3' (SEQ ID NO: 1291)

5'-UGGAUGGAAAGAAACUAAUUUUCAG$_A{}^{C\text{-}3'}$ (SEQ ID NO: 3020)

3'-ACCUACCUUUCUUUGAUUAAAAGUC$_{C_{A\text{-}5'}}$ (SEQ ID NO: 716)

CKAP5-2096 Target: 5'-TGGATGGAAAGAAACTAATTTTCAGGT-3' (SEQ ID NO: 1292)

5'-GAUGGAAAGAAACUAAUUUUCAGGU$_A{}^{C\text{-}3'}$ (SEQ ID NO: 3021)

3'-CUACCUUUCUUUGAUUAAAAGUCCA$_{C_{A\text{-}5'}}$ (SEQ ID NO: 717)

CKAP5-2098 Target: 5'-GATGGAAAGAAACTAATTTTCAGGTGA-3' (SEQ ID NO: 1293)

5'-UGGAAAGAAACUAAUUUUCAGGUGA$_C{}^{A\text{-}3'}$ (SEQ ID NO: 3022)

3'-ACCUUUCUUUGAUUAAAAGUCCACU$_{A_{C\text{-}5'}}$ (SEQ ID NO: 718)

CKAP5-2100 Target: 5'-TGGAAAGAAACTAATTTTCAGGTGATG-3' (SEQ ID NO: 1294)

5'-GAAAGAAACUAAUUUUCAGGUGAUG$_A{}^{C\text{-}3'}$ (SEQ ID NO: 3023)

3'-CUUUCUUUGAUUAAAAGUCCACUAC$_{G_{A\text{-}5'}}$ (SEQ ID NO: 719)

CKAP5-2102 Target: 5'-GAAAGAAACTAATTTTCAGGTGATGCA-3' (SEQ ID NO: 1295)

TABLE 5-continued

Selected Human Anti-CKAP5 "Blunt/Fray" DsiRNAs

5'-AAGAAACUAAUUUUCAGGUGAUGCA$_C{}^{C\text{-}3'}$ (SEQ ID NO: 3024)

3'-UUCUUUGAUUAAAAGUCCACUACGU$_U{}_{A\text{-}5'}$ (SEQ ID NO: 720)

CKAP5-2104 Target: 5'-AAGAAACTAATTTTCAGGTGATGCAAA-3' (SEQ ID NO: 1296)

5'-GAAACUAAUUUUCAGGUGAUGCAAA$_C{}^{A\text{-}3'}$ (SEQ ID NO: 3025)

3'-CUUUGAUUAAAAGUCCACUACGUUU$_A{}_{C\text{-}5'}$ (SEQ ID NO: 721)

CKAP5-2106 Target: 5'-GAAACTAATTTTCAGGTGATGCAAATG-3' (SEQ ID NO: 1297)

5'-AACUAAUUUUCAGGUGAUGCAAAUG$_C{}^{C\text{-}3'}$ (SEQ ID NO: 3026)

3'-UUGAUUAAAAGUCCACUACGUUUAC$_U{}_{A\text{-}5'}$ (SEQ ID NO: 722)

CKAP5-2108 Target: 5'-AACTAATTTTCAGGTGATGCAAATGAA-3' (SEQ ID NO: 1298)

5'-AGUUGCUUUGAUUGCCCAGAAGGGA$_C{}^{C\text{-}3'}$ (SEQ ID NO: 3027)

3'-UCAACGAAACUAACGGGUCUUCCCU$_U{}_{A\text{-}5'}$ (SEQ ID NO: 723)

CKAP5-2144 Target: 5'-AGTTGCTTTGATTGCCCAGAAGGGAAA-3' (SEQ ID NO: 1299)

5'-UUGCUUUGAUUGCCCAGAAGGGAAA$_C{}^{C\text{-}3'}$ (SEQ ID NO: 3028)

3'-AACGAAACUAACGGGUCUUCCCUUU$_A{}_{A\text{-}5'}$ (SEQ ID NO: 724)

CKAP5-2146 Target: 5'-TTGCTTTGATTGCCCAGAAGGGAAATT-3' (SEQ ID NO: 1300)

5'-GCUUUGAUUGCCCAGAAGGGAAAUU$_C{}^{C\text{-}3'}$ (SEQ ID NO: 3029)

3'-CGAAACUAACGGGUCUUCCCUUUAA$_A{}_{A\text{-}5'}$ (SEQ ID NO: 725)

CKAP5-2148 Target: 5'-GCTTTGATTGCCCAGAAGGGAAATTT-3' (SEQ ID NO: 1301)

5'-UUUGAUUGCCCAGAAGGGAAAUUUU$_C{}^{A\text{-}3'}$ (SEQ ID NO: 3030)

3'-AAACUAACGGGUCUUCCCUUUAAAA$_A{}_{G\text{-}5'}$ (SEQ ID NO: 726)

CKAP5-2150 Target: 5'-TTTGATTGCCCAGAAGGGAAATTTTC-3' (SEQ ID NO: 1302)

5'-UGAUUGCCCAGAAGGGAAAUUUUUC$_A{}^{C\text{-}3'}$ (SEQ ID NO: 3031)

3'-ACUAACGGGUCUUCCCUUUAAAAAG$_G{}_{A\text{-}5'}$ (SEQ ID NO: 727)

CKAP5-2152 Target: 5'-TGATTGCCCAGAAGGGAAATTTTTCCA-3' (SEQ ID NO: 1303)

TABLE 5-continued

Selected Human Anti-CKAP5 "Blunt/Fray" DsiRNAs

5'-AUUGCCCAGAAGGGAAAUUUUUCCA$_C{}^{C\text{-}3'}$ (SEQ ID NO: 3032)

3'-UAACGGGUCUUCCCUUUAAAAAGGU$_U{}_{A\text{-}5'}$ (SEQ ID NO: 728)

CKAP5-2154 Target: 5'-ATTGCCCAGAAGGGAAATTTTTCCAAA-3' (SEQ ID NO: 1304)

5'-UGCCCAGAAGGGAAAUUUUUCCAAA$_C{}^{A\text{-}3'}$ (SEQ ID NO: 3033)

3'-ACGGGUCUUCCCUUUAAAAAGGUUU$_U{}_{G\text{-}5'}$ (SEQ ID NO: 729)

CKAP5-2156 Target: 5'-TGCCCAGAAGGGAAATTTTTCCAAAAC-3' (SEQ ID NO: 1305)

5'-UGGACAAGAUUGGAGAUGUGAAAUG$_C{}^{A\text{-}3'}$ (SEQ ID NO: 3034)

3'-ACCUGUUCUAACCUCUACACUUUAC$_A{}_{C\text{-}5'}$ (SEQ ID NO: 730)

CKAP5-2212 Target: 5'-TGGACAAGATTGGAGATGTGAAATGTG-3' (SEQ ID NO: 1306)

5'-GACAAGAUUGGAGAUGUGAAAUGUG$_A{}^{A\text{-}3'}$ (SEQ ID NO: 3035)

3'-CUGUUCUAACCUCUACACUUUACAC$_C{}_{C\text{-}5'}$ (SEQ ID NO: 731)

CKAP5-2214 Target: 5'-GACAAGATTGGAGATGTGAAATGTGGG-3' (SEQ ID NO: 1307)

5'-CAAGAUUGGAGAUGUGAAAUGUGGG$_C{}^{C\text{-}3'}$ (SEQ ID NO: 3036)

3'-GUUCUAACCUCUACACUUUACACCC$_U{}_{A\text{-}5'}$ (SEQ ID NO: 732)

CKAP5-2216 Target: 5'-CAAGATTGGAGATGTGAAATGTGGGAA-3' (SEQ ID NO: 1308)

5'-AGAUUGGAGAUGUGAAAUGUGGGAA$_A{}^{C\text{-}3'}$ (SEQ ID NO: 3037)

3'-UCUAACCUCUACACUUUACACCCUU$_G{}_{A\text{-}5'}$ (SEQ ID NO: 733)

CKAP5-2218 Target: 5'-AGATTGGAGATGTGAAATGTGGGAACA-3' (SEQ ID NO: 1309)

5'-AUUGGAGAUGUGAAAUGUGGGAACA$_C{}^{C\text{-}3'}$ (SEQ ID NO: 3038)

3'-UAACCUCUACACUUUACACCCUUGU$_U{}_{A\text{-}5'}$ (SEQ ID NO: 734)

CKAP5-2220 Target: 5'-ATTGGAGATGTGAAATGTGGGAACAAT-3' (SEQ ID NO: 1310)

5'-UGGAGAUGUGAAAUGUGGGAACAAU$_A{}^{A\text{-}3'}$ (SEQ ID NO: 3039)

3'-ACCUCUACACUUUACACCCUUGUUA$_C{}_{G\text{-}5'}$ (SEQ ID NO: 735)

CKAP5-2222 Target: 5'-TGGAGATGTGAAATGTGGGAACAATGC-3' (SEQ ID NO: 1311)

TABLE 5-continued

Selected Human Anti-CKAP5 "Blunt/Fray" DsiRNAs

5'-GAGAUGUGAAAUGUGGGAACAAUGC$_C{}^{C-3'}$ (SEQ ID NO: 3040)

3'-CUCUACACUUUACACCCUUGUUACG$_U{}_{A-5'}$ (SEQ ID NO: 736)

CKAP5-2224 Target: 5'-GAGATGTGAAATGTGGGAACAATGCAA-3' (SEQ ID NO: 1312)

5'-GAUGUGAAAUGUGGGAACAAUGCAA$_C{}^{C-3'}$ (SEQ ID NO: 3041)

3'-CUACACUUUACACCCUUGUUACGUU$_U{}_{A-5'}$ (SEQ ID NO: 737)

CKAP5-2226 Target: 5'-GATGTGAAATGTGGGAACAATGCAAAA-3' (SEQ ID NO: 1313)

5'-UGUGAAAUGUGGGAACAAUGCAAAA$_A{}^{C-3'}$ (SEQ ID NO: 3042)

3'-ACACUUUACACCCUUGUUACGUUUU$_C{}_{A-5'}$ (SEQ ID NO: 738)

CKAP5-2228 Target: 5'-TGTGAAATGTGGGAACAATGCAAAAGA-3' (SEQ ID NO: 1314)

5'-UGAAAUGUGGGAACAAUGCAAAAGA$_C{}^{A-3'}$ (SEQ ID NO: 3043)

3'-ACUUUACACCCUUGUUACGUUUUCU$_U{}_{C-5'}$ (SEQ ID NO: 739)

CKAP5-2230 Target: 5'-TGAAATGTGGGAACAATGCAAAAGAAG-3' (SEQ ID NO: 1315)

5'-AAAUGUGGGAACAAUGCAAAAGAAG$_A{}^{C-3'}$ (SEQ ID NO: 3044)

3'-UUUACACCCUUGUUACGUUUUCUUC$_G{}_{A-5'}$ (SEQ ID NO: 740)

CKAP5-2232 Target: 5'-AAATGTGGGAACAATGCAAAAGAAGCT-3' (SEQ ID NO: 1316)

5'-AUGUGGGAACAAUGCAAAAGAAGCU$_C{}^{C-3'}$ (SEQ ID NO: 3045)

3'-UACACCCUUGUUACGUUUUCUUCGA$_U{}_{A-5'}$ (SEQ ID NO: 741)

CKAP5-2234 Target: 5'-ATGTGGGAACAATGCAAAAGAAGCTAT-3' (SEQ ID NO: 1317)

5'-GUGGGAACAAUGCAAAAGAAGCUAU$_A{}^{C-3'}$ (SEQ ID NO: 3046)

3'-CACCCUUGUUACGUUUUCUUCGAUA$_C{}_{A-5'}$ (SEQ ID NO: 742)

CKAP5-2236 Target: 5'-GTGGGAACAATGCAAAAGAAGCTATGA-3' (SEQ ID NO: 1318)

5'-GGGAACAAUGCAAAAGAAGCUAUUA$_A{}^{A-3'}$ (SEQ ID NO: 3047)

3'-CCCUUGUUACGUUUUCUUCGAUAAU$_C{}_{G-5'}$ (SEQ ID NO: 743)

CKAP5-2400 Target: 5'-GGGTTGAATGTCAAAGCTTTCATTAGC-3' (SEQ ID NO: 1319)

TABLE 5-continued

Selected Human Anti-CKAP5 "Blunt/Fray" DsiRNAs

5'-GUUGAAUGUCAAAGCUUUCAUUAGC$_C$$^{C-3'}$ (SEQ ID NO: 3048)

3'-CAACUUACAGUUUCGAAAGUAAUCG$_U$$_{A-5'}$ (SEQ ID NO: 744)

CKAP5-2402 Target: 5'-GTTGAATGTCAAAGCTTTCATTAGCAA-3' (SEQ ID NO: 1320)

5'-UGAAUGUCAAAGCUUUCAUUAGCAA$_C$$^{A-3'}$ (SEQ ID NO: 3049)

3'-ACUUACAGUUUCGAAAGUAAUCGUU$_A$$_{C-5'}$ (SEQ ID NO: 745)

CKAP5-2404 Target: 5'-TGAATGTCAAAGCTTTCATTAGCAATG-3' (SEQ ID NO: 1321)

5'-AAUGUCAAAGCUUUCAUUAGCAAUG$_C$$^{A-3'}$ (SEQ ID NO: 3050)

3'-UUACAGUUUCGAAAGUAAUCGUUAC$_A$$_{C-5'}$ (SEQ ID NO: 746)

CKAP5-2406 Target: 5'-AATGTCAAAGCTTTCATTAGCAATGTG-3' (SEQ ID NO: 1322)

5'-UGUCAAAGCUUUCAUUAGCAAUGUG$_C$$^{C-3'}$ (SEQ ID NO: 3051)

3'-ACAGUUUCGAAAGUAAUCGUUACAC$_U$$_{A-5'}$ (SEQ ID NO: 747)

CKAP5-2408 Target: 5'-TGTCAAAGCTTTCATTAGCAATGTGAA-3' (SEQ ID NO: 1323)

5'-AACCCUGCUUGGCGUGAUGUAUCUG$_C$$^{C-3'}$ (SEQ ID NO: 3052)

3'-UUGGGACGAACCGCACUACAUAGAC$_A$$_{A-5'}$ (SEQ ID NO: 748)

CKAP5-2480 Target: 5'-AACCCTGCTTGGCGTGATGTATCTGTA-3' (SEQ ID NO: 1324)

5'-CCCUGCUUGGCGUGAUGUAUCUGUA$_C$$^{A-3'}$ (SEQ ID NO: 3053)

3'-GGGACGAACCGCACUACAUAGACAU$_A$$_{C-5'}$ (SEQ ID NO: 749)

CKAP5-2482 Target: 5'-CCCTGCTTGGCGTGATGTATCTGTATG-3' (SEQ ID NO: 1325)

5'-GUUCUUUGAGGAUGAGAAGCCUGCC$_A$$^{C-3'}$ (SEQ ID NO: 3054)

3'-CAAGAAACUCCUACUCUUCGGACGG$_G$$_{A-5'}$ (SEQ ID NO: 750)

CKAP5-2528 Target: 5'-GTTCTTTGAGGATGAGAAGCCTGCCCT-3' (SEQ ID NO: 1326)

5'-UCUUUGAGGAUGAGAAGCCUGCCCU$_A$$^{A-3'}$ (SEQ ID NO: 3055)

3'-AGAAACUCCUACUCUUCGGACGGGA$_G$$_{G-5'}$ (SEQ ID NO: 751)

CKAP5-2530 Target: 5'-TCTTTGAGGATGAGAAGCCTGCCCTCC-3' (SEQ ID NO: 1327)

TABLE 5-continued

Selected Human Anti-CKAP5 "Blunt/Fray" DsiRNAs

5'-UUUGAGGAUGAGAAGCUGCCCUCC$_C{}^{C\text{-}3'}_{}$  (SEQ ID NO: 3056)

3'-AAACUCCUACUCUUCGGACGGGAGG$_A{}_{A\text{-}5'}$  (SEQ ID NO: 752)

CKAP5-2532 Target: 5'-TTTGAGGATGAGAAGCCTGCCCTCCTA-3' (SEQ ID NO: 1328)

5'-UGAGGAUGAGAAGCCUGCCCUCCUA$_C{}^{A\text{-}3'}_{}$  (SEQ ID NO: 3057)

3'-ACUCCUACUCUUCGGACGGGAGGAU$_A{}_{G\text{-}5'}$  (SEQ ID NO: 753)

CKAP5-2534 Target: 5'-TGAGGATGAGAAGCCTGCCCTCCTATC-3' (SEQ ID NO: 1329)

5'-AGGAUGAGAAGCCUGCCCUCCUAUC$_A{}^{A\text{-}3'}_{}$  (SEQ ID NO: 3058)

3'-UCCUACUCUUCGGACGGGAGGAUAG$_G{}_{G\text{-}5'}$  (SEQ ID NO: 754)

CKAP5-2536 Target: 5'-AGGATGAGAAGCCTGCCCTCCTATCCC-3' (SEQ ID NO: 1330)

5'-GAUGAGAAGCCUGCCCUCCUAUCCC$_C{}^{A\text{-}3'}_{}$  (SEQ ID NO: 3059)

3'-CUACUCUUCGGACGGGAGGAUAGGG$_U{}_{C\text{-}5'}$  (SEQ ID NO: 755)

CKAP5-2538 Target: 5'-GATGAGAAGCCTGCCCTCCTATCCCAG-3' (SEQ ID NO: 1331)

5'-UGAGAAGCCUGCCCUCCUAUCCCAG$_C{}^{C\text{-}3'}_{}$  (SEQ ID NO: 3060)

3'-ACUCUUCGGACGGGAGGAUAGGGUC$_U{}_{A\text{-}5'}$  (SEQ ID NO: 756)

CKAP5-2540 Target: 5'-TGAGAAGCCTGCCCTCCTATCCCAGAT-3' (SEQ ID NO: 1332)

5'-AGAAGCCUGCCCUCCUAUCCCAGAU$_C{}^{A\text{-}3'}_{}$  (SEQ ID NO: 3061)

3'-UCUUCGGACGGGAGGAUAGGGUCUA$_U{}_{C\text{-}5'}$  (SEQ ID NO: 757)

CKAP5-2542 Target: 5'-AGAAGCCTGCCCTCCTATCCCAGATAG-3' (SEQ ID NO: 1333)

5'-AAGCCUGCCCUCCUAUCCCAGAUAG$_C{}^{C\text{-}3'}_{}$  (SEQ ID NO: 3062)

3'-UUCGGACGGGAGGAUAGGGUCUAUC$_U{}_{A\text{-}5'}$  (SEQ ID NO: 758)

CKAP5-2544 Target: 5'-AAGCCTGCCCTCCTATCCCAGATAGAT-3' (SEQ ID NO: 1334)

5'-GCCUGCCCUCCUAUCCCAGAUAGAU$_A{}^{A\text{-}3'}_{}$  (SEQ ID NO: 3063)

3'-CGGACGGGAGGAUAGGGUCUAUCUA$_C{}_{G\text{-}5'}$  (SEQ ID NO: 759)

CKAP5-2546 Target: 5'-GCCTGCCCTCCTATCCCAGATAGATGC-3' (SEQ ID NO: 1335)

TABLE 5-continued

Selected Human Anti-CKAP5 "Blunt/Fray" DsiRNAs

5'-CUGCCCUCCUAUCCCAGAUAGAUGC$_C^{A-3'}$  (SEQ ID NO: 3064)

3'-GACGGGAGGAUAGGGUCUAUCUACG$_U{}_{G-5'}$  (SEQ ID NO: 760)

CKAP5-2548 Target: 5'-CTGCCCTCCTATCCCAGATAGATGCAG-3' (SEQ ID NO: 1336)

5'-GCCCUCCUAUCCCAGAUAGAUGCAG$_C^{C-3'}$  (SEQ ID NO: 3065)

3'-CGGGAGGAUAGGGUCUAUCUACGUC$_U{}_{A-5'}$  (SEQ ID NO: 761)

CKAP5-2550 Target: 5'-GCCCTCCTATCCCAGATAGATGCAGAA-3' (SEQ ID NO: 1337)

5'-CCUCCUAUCCCAGAUAGAUGCAGAA$_C^{C-3'}$  (SEQ ID NO: 3066)

3'-GGAGGAUAGGGUCUAUCUACGUCUU$_A{}_{A-5'}$  (SEQ ID NO: 762)

CKAP5-2552 Target: 5'-CCTCCTATCCCAGATAGATGCAGAATT-3' (SEQ ID NO: 1338)

5'-UCCUAUCCCAGAUAGAUGCAGAAUU$_C^{A-3'}$  (SEQ ID NO: 3067)

3'-AGGAUAGGGUCUAUCUACGUCUUAA$_A{}_{C-5'}$  (SEQ ID NO: 763)

CKAP5-2554 Target: 5'-TCCTATCCCAGATAGATGCAGAATTTG-3' (SEQ ID NO: 1339)

5'-CUAUCCCAGAUAGAUGCAGAAUUUG$_C^{A-3'}$  (SEQ ID NO: 3068)

3'-GAUAGGGUCUAUCUACGUCUUAAAC$_U{}_{C-5'}$  (SEQ ID NO: 764)

CKAP5-2556 Target: 5'-CTATCCCAGATAGATGCAGAATTTGAG-3' (SEQ ID NO: 1340)

5'-AUCCCAGAUAGAUGCAGAAUUUGAG$_C^{C-3'}$  (SEQ ID NO: 3069)

3'-UAGGGUCUAUCUACGUCUUAAACUC$_U{}_{A-5'}$  (SEQ ID NO: 765)

CKAP5-2558 Target: 5'-ATCCCAGATAGATGCAGAATTTGAGAA-3' (SEQ ID NO: 1341)

5'-AGAAGAUGCAGGGACAAGUCCACC$_C^{A-3'}$  (SEQ ID NO: 3070)

3'-UCUUCUACGUCCCUGUUUCAGGUGG$_A{}_{C-5'}$  (SEQ ID NO: 766)

CKAP5-2581 Target: 5'-AGAAGATGCAGGGACAAAGTCCACCTG-3' (SEQ ID NO: 1342)

5'-GGUACAGAUGAAGGAGAAGAUGGAG$_C^{C-3'}$  (SEQ ID NO: 3071)

3'-CCAUGUCUACUUCCUCUUCUACCUC$_U{}_{A-5'}$  (SEQ ID NO: 767)

CKAP5-2643 Target: 5'-GGTACAGATGAAGGAGAAGATGGAGAT-3' (SEQ ID NO: 1343)

TABLE 5-continued

Selected Human Anti-CKAP5 "Blunt/Fray" DsiRNAs

5'-UACAGAUGAAGGAGAAGAUGGAGAU$_A$$^{C-3'}$ (SEQ ID NO: 3072)

3'-AUGUCUACUUCCUCUUCUACCUCUA$_C$$_{A-5'}$ (SEQ ID NO: 768)

CKAP5-2645 Target: 5'-TACAGATGAAGGAGAAGATGGAGATGA-3' (SEQ ID NO: 1344)

5'-CAGAUGAAGGAGAAGAUGGAGAUGA$_C$$^{A-3'}$ (SEQ ID NO: 3073)

3'-GUCUACUUCCUCUUCUACCUCUACU$_U$$_{G-5'}$ (SEQ ID NO: 769)

CKAP5-2647 Target: 5'-CAGATGAAGGAGAAGATGGAGATGAAC-3' (SEQ ID NO: 1345)

5'-UCGUUGAUCUUUUGCCGAGGACGGA$_A$$^{C-3'}$ (SEQ ID NO: 3074)

3'-AGCAACUAGAAAACGGCUCCUGCCU$_C$$_{A-5'}$ (SEQ ID NO: 770)

CKAP5-2695 Target: 5'-TCGTTGATCTTTTGCCGAGGACGGAGA-3' (SEQ ID NO: 1346)

5'-UAGGAAAGAAGGCCUAGAUGAAGUG$_A$$^{A-3'}$ (SEQ ID NO: 3075)

3'-AUCCUUUCUUCCGGAUCUACUUCAC$_C$$_{G-5'}$ (SEQ ID NO: 771)

CKAP5-2780 Target: 5'-TAGGAAAGAAGGCCTAGATGAAGTGGC-3' (SEQ ID NO: 1347)

5'-GGAAAGAAGGCCUAGAUGAAGUGGC$_C$$^{A-3'}$ (SEQ ID NO: 3076)

3'-CCUUUCUUCCGGAUCUACUUCACCG$_U$$_{C-5'}$ (SEQ ID NO: 772)

CKAP5-2782 Target: 5'-GGAAAGAAGGCCTAGATGAAGTGGCAG-3' (SEQ ID NO: 1348)

5'-AAAGAAGGCCUAGAUGAAGUGGCAG$_A$$^{C-3'}$ (SEQ ID NO: 3077)

3'-UUUCUUCCGGAUCUACUUCACCGUC$_C$$_{A-5'}$ (SEQ ID NO: 773)

CKAP5-2784 Target: 5'-AAAGAAGGCCTAGATGAAGTGGCAGGT-3' (SEQ ID NO: 1349)

5'-AGAAGGCCUAGAUGAAGUGGCAGGU$_C$$^{C-3'}$ (SEQ ID NO: 3078)

3'-UCUUCCGGAUCUACUUCACCGUCCA$_U$$_{A-5'}$ (SEQ ID NO: 774)

CKAP5-2786 Target: 5'-AGAAGGCCTAGATGAAGTGGCAGGTAT-3' (SEQ ID NO: 1350)

5'-AAGGCCUAGAUGAAGUGGCAGGUAU$_C$$^{C-3'}$ (SEQ ID NO: 3079)

3'-UUCCGGAUCUACUUCACCGUCCAUA$_A$$_{A-5'}$ (SEQ ID NO: 775)

CKAP5-2788 Target: 5'-AAGGCCTAGATGAAGTGGCAGGTATTA-3' (SEQ ID NO: 1351)

TABLE 5-continued

Selected Human Anti-CKAP5 "Blunt/Fray" DsiRNAs

5'-GGCCUAGAUGAAGUGGCAGGUAUUA$_C{}^{C\text{-}3'}$ (SEQ ID NO: 3080)

3'-CCGGAUCUACUUCACCGUCCAUAAU$_A{}_{A\text{-}5'}$ (SEQ ID NO: 776)

CKAP5-2790 Target: 5'-GGCCTAGATGAAGTGGCAGGTATTATT-3' (SEQ ID NO: 1352)

5'-CCUAGAUGAAGUGGCAGGUAUUAUU$_C{}^{C\text{-}3'}$ (SEQ ID NO: 3081)

3'-GGAUCUACUUCACCGUCCAUAAUAA$_U{}_{A\text{-}5'}$ (SEQ ID NO: 777)

CKAP5-2792 Target: 5'-CCTAGATGAAGTGGCAGGTATTATTAA-3' (SEQ ID NO: 1353)

5'-UAGAUGAAGUGGCAGGUAUUAUUAA$_C{}^{A\text{-}3'}$ (SEQ ID NO: 3082)

3'-AUCUACUUCACCGUCCAUAAUAAUU$_A{}_{C\text{-}5'}$ (SEQ ID NO: 778)

CKAP5-2794 Target: 5'-TAGATGAAGTGGCAGGTATTATTAATG-3' (SEQ ID NO: 1354)

5'-CGAAUAUAGGUGAACUUCCAACUGC$_A{}^{C\text{-}3'}$ (SEQ ID NO: 3083)

3'-GCUUAUAUCCACUUGAAGGUUGACG$_G{}_{A\text{-}5'}$ (SEQ ID NO: 779)

CKAP5-2839 Target: 5'-CGAATATAGGTGAACTTCCAACTGCCT-3' (SEQ ID NO: 1355)

5'-AAUAUAGGUGAACUUCCAACUGCCU$_C{}^{A\text{-}3'}$ (SEQ ID NO: 3084)

3'-UUAUAUCCACUUGAAGGUUGACGGA$_A{}_{C\text{-}5'}$ (SEQ ID NO: 780)

CKAP5-2841 Target: 5'-AATATAGGTGAACTTCCAACTGCCTTG-3' (SEQ ID NO: 1356)

5'-UAUAGGUGAACUUCCAACUGCCUUG$_C{}^{C\text{-}3'}$ (SEQ ID NO: 3085)

3'-AUAUCCACUUGAAGGUUGACGGAAC$_U{}_{A\text{-}5'}$ (SEQ ID NO: 781)

CKAP5-2843 Target: 5'-TATAGGTGAACTTCCAACTGCCTTGAA-3' (SEQ ID NO: 1357)

5'-UAGGUGAACUUCCAACUGCCUUGAA$_A{}^{A\text{-}3'}$ (SEQ ID NO: 3086)

3'-AUCCACUUGAAGGUUGACGGAACUU$_C{}_{C\text{-}5'}$ (SEQ ID NO: 782)

CKAP5-2845 Target: 5'-TAGGTGAACTTCCAACTGCCTTGAAGG-3' (SEQ ID NO: 1358)

5'-GGUGAACUUCCAACUGCCUUGAAGG$_A{}^{C\text{-}3'}$ (SEQ ID NO: 3087)

3'-CCACUUGAAGGUUGACGGAACUUCC$_C{}_{A\text{-}5'}$ (SEQ ID NO: 783)

CKAP5-2847 Target: 5'-GGTGAACTTCCAACTGCCTTGAAGGGT-3' (SEQ ID NO: 1359)

TABLE 5-continued

Selected Human Anti-CKAP5 "Blunt/Fray" DsiRNAs

5'-UGAACUUCCAACUGCCUUGAAGGGU$_A$$^{A-3'}_A$ (SEQ ID NO: 3088)

3'-ACUUGAAGGUUGACGGAACUUCCCA$_G$$_{C-5'}$ (SEQ ID NO: 784)

CKAP5-2849 Target: 5'-TGAACTTCCAACTGCCTTGAAGGGTCG-3' (SEQ ID NO: 1360)

5'-AACUUCCAACUGCCUUGAAGGGUCG$_A$$^{A-3'}$ (SEQ ID NO: 3089)

3'-UUGAAGGUUGACGGAACUUCCCAGC$_U$$_{G-5'}$ (SEQ ID NO: 785)

CKAP5-2851 Target: 5'-AACTTCCAACTGCCTTGAAGGGTCGAC-3' (SEQ ID NO: 1361)

5'-CUUCCAACUGCCUUGAAGGGUCGAC$_C$$^{A-3'}$ (SEQ ID NO: 3090)

3'-GAAGGUUGACGGAACUUCCCAGCUG$_A$$_{G-5'}$ (SEQ ID NO: 786)

CKAP5-2853 Target: 5'-CTTCCAACTGCCTTGAAGGGTCGACTC-3' (SEQ ID NO: 1362)

5'-UCCAACUGCCUUGAAGGGUCGACUC$_C$$^{C-3'}$ (SEQ ID NO: 3091)

3'-AGGUUGACGGAACUUCCCAGCUGAG$_U$$_{A-5'}$ (SEQ ID NO: 787)

CKAP5-2855 Target: 5'-TCCAACTGCCTTGAAGGGTCGACTCAA-3' (SEQ ID NO: 1363)

5'-CAACUGCCUUGAAGGGUCGACUCAA$_C$$^{A-3'}$ (SEQ ID NO: 3092)

3'-GUUGACGGAACUUCCCAGCUGAGUU$_A$$_{C-5'}$ (SEQ ID NO: 788)

CKAP5-2857 Target: 5'-CAACTGCCTTGAAGGGTCGACTCAATG-3' (SEQ ID NO: 1364)

5'-AACAACUGGCAGUAGCCAUGGGCCC$_C$$^{C-3'}$ (SEQ ID NO: 3093)

3'-UUGUUGACCGUCAUCGGUACCCGGG$_U$$_{A-5'}$ (SEQ ID NO: 789)

CKAP5-2926 Target: 5'-AACAACTGGCAGTAGCCATGGGCCCAA-3' (SEQ ID NO: 1365)

5'-ACAGCAAGAACAAUGUUCGAGCUGC$_C$$^{A-3'}$ (SEQ ID NO: 3094)

3'-UGUCGUUCUUGUUACAAGCUCGACG$_A$$_{C-5'}$ (SEQ ID NO: 790)

CKAP5-3007 Target: 5'-ACAGCAAGAACAATGTTCGAGCTGCTG-3' (SEQ ID NO: 1366)

5'-AGCAAGAACAAUGUUCGAGCUGCUG$_A$$^{A-3'}$ (SEQ ID NO: 3095)

3'-UCGUUCUUGUUACAAGCUCGACGAC$_G$$_{G-5'}$ (SEQ ID NO: 791)

CKAP5-3009 Target: 5'-AGCAAGAACAATGTTCGAGCTGCTGCC-3' (SEQ ID NO: 1367)

TABLE 5-continued

Selected Human Anti-CKAP5 "Blunt/Fray" DsiRNAs

5'-CAAGAACAAUGUUCGAGCUGCUGCC$_A^{C-3'}$C (SEQ ID NO: 3096)

3'-GUUCUUGUUACAAGCUCGACGACGG$_{A-5'}^G$ (SEQ ID NO: 792)

CKAP5-3011 Target: 5'-CAAGAACAATGTTCGAGCTGCTGCCCT-3' (SEQ ID NO: 1368)

5'-AGAACAAUGUUCGAGCUGCUGCCCU$_C^{A-3'}$ (SEQ ID NO: 3097)

3'-UCUUGUUACAAGCUCGACGACGGGA$_{C-5'}^U$ (SEQ ID NO: 793)

CKAP5-3013 Target: 5'-AGAACAATGTTCGAGCTGCTGCCCTAG-3' (SEQ ID NO: 1369)

5'-AACAAUGUUCGAGCUGCUGCCCUAG$_A^{A-3'}$ (SEQ ID NO: 3098)

3'-UUGUUACAAGCUCGACGACGGGAUC$_{C-5'}^G$ (SEQ ID NO: 794)

CKAP5-3015 Target: 5'-AACAATGTTCGAGCTGCTGCCCTAGCG-3' (SEQ ID NO: 1370)

5'-CAAUGUUCGAGCUGCUGCCCUAGCG$_C^{A-3'}$ (SEQ ID NO: 3099)

3'-GUUACAAGCUCGACGACGGGAUCGC$_{G-5'}^U$ (SEQ ID NO: 795)

CKAP5-3017 Target: 5'-CAATGTTCGAGCTGCTGCCCTAGCGAC-3' (SEQ ID NO: 1371)

5'-AUGUUCGAGCUGCUGCCCUAGCGAC$_C^{A-3'}$ (SEQ ID NO: 3100)

3'-UACAAGCUCGACGACGGGAUCGCUG$_{C-5'}^A$ (SEQ ID NO: 796)

CKAP5-3019 Target: 5'-ATGTTCGAGCTGCTGCCCTAGCGACTG-3' (SEQ ID NO: 1372)

5'-CGACUGUGAAUGCUUGGGCAGAACA$_A^{C-3'}$ (SEQ ID NO: 3101)

3'-GCUGACACUUACGAACCCGUCUUGU$_{A-5'}^C$ (SEQ ID NO: 797)

CKAP5-3040 Target: 5'-CGACTGTGAATGCTTGGGCAGAACAGA-3' (SEQ ID NO: 1373)

5'-ACUGUGAAUGCUUGGGCAGAACAGA$_A^{C-3'}$ (SEQ ID NO: 3102)

3'-UGACACUUACGAACCCGUCUUGUCU$_{A-5'}^G$ (SEQ ID NO: 798)

CKAP5-3042 Target: 5'-ACTGTGAATGCTTGGGCAGAACAGACT-3' (SEQ ID NO: 1374)

5'-UGUGAAUGCUUGGGCAGAACAGACU$_A^{A-3'}$ (SEQ ID NO: 3103)

3'-ACACUUACGAACCCGUCUUGUCUGA$_{C-5'}$ (SEQ ID NO: 799)

CKAP5-3044 Target: 5'-TGTGAATGCTTGGGCAGAACAGACTGG-3' (SEQ ID NO: 1375)

TABLE 5-continued

Selected Human Anti-CKAP5 "Blunt/Fray" DsiRNAs

5'-AGGAGAAGAUCUUUCUGAAGAGCUC$_C{}^{C-3'}$ (SEQ ID NO: 3104)

3'-UCCUCUUCUAGAAAGACUUCUCGAG$_U{}_{A-5'}$ (SEQ ID NO: 800)

CKAP5-3089 Target: 5'-AGGAGAAGATCTTTCTGAAGAGCTCAA-3' (SEQ ID NO: 1376)

5'-GCCUAGGAGAUCGAAAUGGAGAUGU$_A{}^{A-3'}$ (SEQ ID NO: 3105)

3'-CGGAUCUUCUAGCUUUACCUCUACA$_C{}_{G-5'}$ (SEQ ID NO: 801)

CKAP5-3229 Target: 5'-GCCTAGAAGATCGAAATGGAGATGTGC-3' (SEQ ID NO: 1377)

5'-CUAGGAGAUCGAAAUGGAGAUGUGC$_A{}^{C-3'}$ (SEQ ID NO: 3106)

3'-GAUCUUCUAGCUUUACCUCUACACG$_C{}_{A-5'}$ (SEQ ID NO: 802)

CKAP5-3231 Target: 5'-CTAGAAGATCGAAATGGAGATGTGCGA-3' (SEQ ID NO: 1378)

5'-AGGAGAUCGAAAUGGAGAUGUGCGA$_C{}^{C-3'}$ (SEQ ID NO: 3107)

3'-UCUUCUAGCUUUACCUCUACACGCU$_U{}_{A-5'}$ (SEQ ID NO: 803)

CKAP5-3233 Target: 5'-AGAAGATCGAAATGGAGATGTGCGAAA-3' (SEQ ID NO: 1379)

5'-CAUGAUGCAUUUAGGAUAUGAAAAA$_C{}^{C-3'}$ (SEQ ID NO: 3108)

3'-GUACUACGUAAAUCCUAUACUUUUU$_U{}_{A-5'}$ (SEQ ID NO: 804)

CKAP5-3287 Target: 5'-CATGATGCATTTAGGATATGAAAAAAT-3' (SEQ ID NO: 1380)

5'-UGAUGCAUUUAGGAUAUGAAAAAAU$_A{}^{A-3'}$ (SEQ ID NO: 3109)

3'-ACUACGUAAAUCCUAUACUUUUUUA$_C{}_{C-5'}$ (SEQ ID NO: 805)

CKAP5-3289 Target: 5'-TGATGCATTTAGGATATGAAAAAATGG-3' (SEQ ID NO: 1381)

5'-AUGCAUUUAGGAUAUGAAAAAAUGG$_A{}^{A-3'}$ (SEQ ID NO: 3110)

3'-UACGUAAAUCCUAUACUUUUUUACC$_G{}_{G-5'}$ (SEQ ID NO: 806)

CKAP5-3291 Target: 5'-ATGCATTTAGGATATGAAAAAATGGCC-3' (SEQ ID NO: 1382)

5'-GCAUUUAGGAUAUGAAAAAAUGGCC$_C{}^{C-3'}$ (SEQ ID NO: 3111)

3'-CGUAAAUCCUAUACUUUUUUACCGG$_U{}_{A-5'}$ (SEQ ID NO: 807)

CKAP5-3293 Target: 5'-GCATTTAGGATATGAAAAAATGGCCAA-3' (SEQ ID NO: 1383)

TABLE 5-continued

Selected Human Anti-CKAP5 "Blunt/Fray" DsiRNAs

5'-AUUUAGGAUAUGAAAAAAUGGCCAA$_A{}^{A-3'}_{A}$ (SEQ ID NO: 3112)

3'-UAAAUCCUAUACUUUUUUACCGGUU$_C{}_{C-5'}$ (SEQ ID NO: 808)

CKAP5-3295 Target: 5'-ATTTAGGATATGAAAAAATGGCCAAGG-3' (SEQ ID NO: 1384)

5'-CCAAGGCUACUGGGAAACUAAAGCC$_C{}^{C-3'}$ (SEQ ID NO: 3113)

3'-GGUUCCGAUGACCCUUUGAUUUCGG$_U{}_{A-5'}$ (SEQ ID NO: 809)

CKAP5-3316 Target: 5'-CCAAGGCTACTGGGAAACTAAAGCCAA-3' (SEQ ID NO: 1385)

5'-AAGGCUACUGGGAAACUAAAGCCAA$_A{}^{C-3'}$ (SEQ ID NO: 3114)

3'-UUCCGAUGACCCUUUGAUUUCGGUU$_G{}_{A-5'}$ (SEQ ID NO: 810)

CKAP5-3318 Target: 5'-AAGGCTACTGGGAAACTAAAGCCAACT-3' (SEQ ID NO: 1386)

5'-GGCUACUGGGAAACUAAAGCCAACU$_C{}^{A-3'}$ (SEQ ID NO: 3115)

3'-CCGAUGACCCUUUGAUUUCGGUUGA$_A{}_{G-5'}$ (SEQ ID NO: 811)

CKAP5-3320 Target: 5'-GGCTACTGGGAAACTAAAGCCAACTTC-3' (SEQ ID NO: 1387)

5'-CUACUGGGAAACUAAAGCCAACUUC$_C{}^{C-3'}$ (SEQ ID NO: 3116)

3'-GAUGACCCUUUGAUUUCGGUUGAAG$_A{}_{A-5'}$ (SEQ ID NO: 812)

CKAP5-3322 Target: 5'-CTACTGGGAAACTAAAGCCAACTTCTA-3' (SEQ ID NO: 1388)

5'-ACUGGGAAACUAAAGCCAACUUCUA$_C{}^{C-3'}$ (SEQ ID NO: 3117)

3'-UGACCCUUUGAUUUCGGUUGAAGAU$_U{}_{A-5'}$ (SEQ ID NO: 813)

CKAP5-3324 Target: 5'-ACTGGGAAACTAAAGCCAACTTCTAAA-3' (SEQ ID NO: 1389)

5'-UGGGAAACUAAAGCCAACUUCUAAA$_A{}^{C-3'}$ (SEQ ID NO: 3118)

3'-ACCCUUUGAUUUCGGUUGAAGAUUU$_C{}_{A-5'}$ (SEQ ID NO: 814)

CKAP5-3326 Target: 5'-TGGGAAACTAAAGCCAACTTCTAAAGA-3' (SEQ ID NO: 1390)

5'-GGAAACUAAAGCCAACUUCUAAAGA$_C{}^{A-3'}$ (SEQ ID NO: 3119)

3'-CCUUUGAUUUCGGUUGAAGAUUUCU$_A{}_{G-5'}$ (SEQ ID NO: 815)

CKAP5-3328 Target: 5'-GGAAACTAAAGCCAACTTCTAAAGATC-3' (SEQ ID NO: 1391)

TABLE 5-continued

Selected Human Anti-CKAP5 "Blunt/Fray" DsiRNAs

5'-AAACUAAAGCCAACUUCUAAAGAUC$_C{}^{A\text{-}3'}$ (SEQ ID NO: 3120)

3'-UUUGAUUUCGGUUGAAGAUUUCUAG$_U{}_{C\text{-}5'}$ (SEQ ID NO: 816)

CKAP5-3330 Target: 5'-AAACTAAAGCCAACTTCTAAAGATCAG-3' (SEQ ID NO: 1392)

5'-ACUAAAGCCAACUUCUAAAGAUCAG$_C{}^{A\text{-}3'}$ (SEQ ID NO: 3121)

3'-UGAUUUCGGUUGAAGAUUUCUAGUC$_C{}_{A\text{-}5'}$ (SEQ ID NO: 817)

CKAP5-3332 Target: 5'-ACTAAAGCCAACTTCTAAAGATCAGGT-3' (SEQ ID NO: 1393)

5'-UAAAGCCAACUUCUAAAGAUCAGGU$_C{}^{C\text{-}3'}$ (SEQ ID NO: 3122)

3'-AUUUCGGUUGAAGAUUUCUAGUCCA$_U{}_{A\text{-}5'}$ (SEQ ID NO: 818)

CKAP5-3334 Target: 5'-TAAAGCCAACTTCTAAAGATCAGGTAT-3' (SEQ ID NO: 1394)

5'-GGCCUAUUUUUAUUGUUGUUCCAAA$_C{}^{C\text{-}3'}$ (SEQ ID NO: 3123)

3'-CCGGAUAAAAAUAACAACAAGGUUU$_A{}_{C\text{-}5'}$ (SEQ ID NO: 819)

CKAP5-3625 Target: 5'-GGCCTATTTTTATTGTTGTTCCAAATG-3' (SEQ ID NO: 1395)

5'-CCUAUUUUUAUUGUUGUUCCAAAUG$_A{}^{C\text{-}3'}$ (SEQ ID NO: 3124)

3'-GGAUAAAAAUAACAACAAGGUUUAC$_C{}_{A\text{-}5'}$ (SEQ ID NO: 820)

CKAP5-3627 Target: 5'-CCTATTTTTATTGTTGTTCCAAATGGA-3' (SEQ ID NO: 1396)

5'-UAUUUUUAUUGUUGUUCCAAAUGGA$_C{}^{C\text{-}3'}$ (SEQ ID NO: 3125)

3'-AUAAAAAUAACAACAAGGUUUACCU$_U{}_{A\text{-}5'}$ (SEQ ID NO: 821)

CKAP5-3629 Target: 5'-TATTTTTATTGTTGTTCCAAATGGAAA-3' (SEQ ID NO: 1397)

5'-UUUUUAUUGUUGUUCCAAAUGGAAA$_C{}^{A\text{-}3'}$ (SEQ ID NO: 3126)

3'-AAAAAUAACAACAAGGUUUACCUUU$_U{}_{C\text{-}5'}$ (SEQ ID NO: 822)

CKAP5-3631 Target: 5'-TTTTTATTGTTGTTCCAAATGGAAAAG-3' (SEQ ID NO: 1398)

5'-UUUAUUGUUGUUCCAAAUGGAAAAG$_C{}^{A\text{-}3'}$ (SEQ ID NO: 3127)

3'-AAAUAACAACAAGGUUUACCUUUUC$_U{}_{C\text{-}5'}$ (SEQ ID NO: 823)

CKAP5-3633 Target: 5'-TTTATTGTTGTTCCAAATGGAAAAGAG-3' (SEQ ID NO: 1399)

TABLE 5-continued

Selected Human Anti-CKAP5 "Blunt/Fray" DsiRNAs

5'-UAUUGUUGUUCCAAAUGGAAAAGAG$_A{}^{C-3'}_A$ (SEQ ID NO: 3128)

3'-AUAACAACAAGGUUUACCUUUUCUC$_G{}_{A-5'}$ (SEQ ID NO: 824)

CKAP5-3635 Target: 5'-TATTGTTGTTCCAAATGGAAAAGAGCA-3' (SEQ ID NO: 1400)

5'-GAAGGUGCUAAAGUGGAAUUUUACU$_C{}^{A-3'}$ (SEQ ID NO: 3129)

3'-CUUCCACGAUUUCACCUUAAAAUGA$_U{}_{G-5'}$ (SEQ ID NO: 825)

CKAP5-3686 Target: 5'-GAAGGTGCTAAAGTGGAATTTTACTAC-3' (SEQ ID NO: 1401)

5'-AGGUGCUAAAGUGGAAUUUUACUAC$_A{}^{A-3'}$ (SEQ ID NO: 3130)

3'-UCCACGAUUUCACCUUAAAAUGAUG$_G{}_{G-5'}$ (SEQ ID NO: 826)

CKAP5-3688 Target: 5'-AGGTGCTAAAGTGGAATTTTACTACCC-3' (SEQ ID NO: 1402)

5'-AUAUCAUCUUACUGAGAAUGAAGCA$_C{}^{A-3'}$ (SEQ ID NO: 3131)

3'-UAUAGUAGAAUGACUCUUACUUCGU$_A{}_{G-5'}$ (SEQ ID NO: 827)

CKAP5-3989 Target: 5'-ATATCATCTTACTGAGAATGAAGCATC-3' (SEQ ID NO: 1403)

5'-AUCAUCUUACUGAGAAUGAAGCAUC$_C{}^{C-3'}$ (SEQ ID NO: 3132)

3'-UAGUAGAAUGACUCUUACUUCGUAG$_A{}_{A-5'}$ (SEQ ID NO: 828)

CKAP5-3991 Target: 5'-ATCATCTTACTGAGAATGAAGCATCTT-3' (SEQ ID NO: 1404)

5'-CAUCUUACUGAGAAUGAAGCAUCUU$_A{}^{A-3'}$ (SEQ ID NO: 3133)

3'-GUAGAAUGACUCUUACUUCGUAGAA$_G{}_{G-5'}$ (SEQ ID NO: 829)

CKAP5-3993 Target: 5'-CATCTTACTGAGAATGAAGCATCTTCC-3' (SEQ ID NO: 1405)

5'-UCUUACUGAGAAUGAAGCAUCUUCC$_C{}^{C-3'}$ (SEQ ID NO: 3134)

3'-AGAAUGACUCUUACUUCGUAGAAGG$_A{}_{A-5'}$ (SEQ ID NO: 830)

CKAP5-3995 Target: 5'-TCTTACTGAGAATGAAGCATCTTCCTT-3' (SEQ ID NO: 1406)

5'-GUCAAGGUUGGAGAACCAAAGGAUG$_C{}^{A-3'}$ (SEQ ID NO: 3135)

3'-CAGUUCCAACCUCUUGGUUUCCUAC$_A{}_{G-5'}$ (SEQ ID NO: 831)

CKAP5-4038 Target: 5'-GTCAAGGTTGGAGAACCAAAGGATGTC-3' (SEQ ID NO: 1407)

TABLE 5-continued

Selected Human Anti-CKAP5 "Blunt/Fray" DsiRNAs

5'-CAAGGUUGGAGAACCAAAGGAUGUC$_C$$^{C-3'}$ (SEQ ID NO: 3136)

3'-GUUCCAACCUCUUGGUUUCCUACAG$_U$$_{A-5'}$ (SEQ ID NO: 832)

CKAP5-4040 Target: 5'-CAAGGTTGGAGAACCAAAGGATGTCAT-3' (SEQ ID NO: 1408)

5'-AGGUUGGAGAACCAAAGGAUGUCAU$_C$$^{A-3'}$ (SEQ ID NO: 3137)

3'-UCCAACCUCUUGGUUUCCUACAGUA$_A$$_{G-5'}$ (SEQ ID NO: 833)

CKAP5-4042 Target: 5'-AGGTTGGAGAACCAAAGGATGTCATTC-3' (SEQ ID NO: 1409)

5'-GUUGGAGAACCAAAGGAUGUCAUUC$_A$$^{C-3'}$ (SEQ ID NO: 3138)

3'-CAACCUCUUGGUUUCCUACAGUAAG$_C$$_{A-5'}$ (SEQ ID NO: 834)

CKAP5-4044 Target: 5'-GTTGGAGAACCAAAGGATGTCATTCGT-3' (SEQ ID NO: 1410)

5'-UGGAGAACCAAAGGAUGUCAUUCGU$_A$$^{C-3'}$ (SEQ ID NO: 3139)

3'-ACCUCUUGGUUUCCUACAGUAAGCA$_U$$_{A-5'}$ (SEQ ID NO: 835)

CKAP5-4046 Target: 5'-TGGAGAACCAAAGGATGTCATTCGTAA-3' (SEQ ID NO: 1411)

5'-GAGAACCAAAGGAUGUCAUUCGUAA$_C$$^{A-3'}$ (SEQ ID NO: 3140)

3'-CUCUUGGUUUCCUACAGUAAGCAUU$_U$$_{C-5'}$ (SEQ ID NO: 836)

CKAP5-4048 Target: 5'-GAGAACCAAAGGATGTCATTCGTAAAG-3' (SEQ ID NO: 1412)

5'-GAACCAAAGGAUGUCAUUCGUAAAG$_C$$^{C-3'}$ (SEQ ID NO: 3141)

3'-CUUGGUUUCCUACAGUAAGCAUUUC$_U$$_{A-5'}$ (SEQ ID NO: 837)

CKAP5-4050 Target: 5'-GAACCAAAGGATGTCATTCGTAAAGAT-3' (SEQ ID NO: 1413)

5'-ACCAAAGGAUGUCAUUCGUAAAGAU$_A$$^{C-3'}$ (SEQ ID NO: 3142)

3'-UGGUUUCCUACAGUAAGCAUUUCUA$_C$$_{A-5'}$ (SEQ ID NO: 838)

CKAP5-4052 Target: 5'-ACCAAAGGATGTCATTCGTAAAGATGT-3' (SEQ ID NO: 1414)

5'-CAAAGGAUGUCAUUCGUAAAGAUGU$_C$$^{A-3'}$ (SEQ ID NO: 3143)

3'-GUUUCCUACAGUAAGCAUUUCUACA$_A$$_{G-5'}$ (SEQ ID NO: 839)

CKAP5-4054 Target: 5'-CAAAGGATGTCATTCGTAAAGATGTTC-3' (SEQ ID NO: 1415)

TABLE 5-continued

Selected Human Anti-CKAP5 "Blunt/Fray" DsiRNAs

5'-AAGGAUGUCAUUCGUAAAGAUGUUC$_A$$^{C-3'}$$^C$   (SEQ ID NO: 3144)

3'-UUCCUACAGUAAGCAUUUCUACAAG$_{C_{A-5'}}$   (SEQ ID NO: 840)

CKAP5-4056 Target: 5'-AAGGATGTCATTCGTAAAGATGTTCGT-3' (SEQ ID NO: 1416)

5'-GGAUGUCAUUCGUAAAGAUGUUCGU$_A$$^{A-3'}$   (SEQ ID NO: 3145)

3'-CCUACAGUAAGCAUUUCUACAAGCA$_{C_{G-5'}}$   (SEQ ID NO: 841)

CKAP5-4058 Target: 5'-GGATGTCATTCGTAAAGATGTTCGTGC-3' (SEQ ID NO: 1417)

5'-CAUCCUGAACCGGAUGUGCCUUGUC$_C$$^{C-3'}$   (SEQ ID NO: 3146)

3'-GUAGGACUUGGCCUACACGGAACAG$_{A_{A-5'}}$   (SEQ ID NO: 842)

CKAP5-4085 Target: 5'-CATCCTGAACCGGATGTGCCTTGTCTA-3' (SEQ ID NO: 1418)

5'-UCCUGAACCGGAUGUGCCUUGUCUA$_A$$^{A-3'}$   (SEQ ID NO: 3147)

3'-AGGACUUGGCCUACACGGAACAGAU$_{G_{G-5'}}$   (SEQ ID NO: 843)

CKAP5-4087 Target: 5'-TCCTGAACCGGATGTGCCTTGTCTACC-3' (SEQ ID NO: 1419)

5'-CUGAACCGGAUGUGCCUUGUCUACC$_A$$^{C-3'}$   (SEQ ID NO: 3148)

3'-GACUUGGCCUACACGGAACAGAUGG$_{G_{A-5'}}$   (SEQ ID NO: 844)

CKAP5-4089 Target: 5'-CTGAACCGGATGTGCCTTGTCTACCCA-3' (SEQ ID NO: 1420)

5'-GAACCGGAUGUGCCUUGUCUACCCA$_A$$^{A-3'}$   (SEQ ID NO: 3149)

3'-CUUGGCCUACACGGAACAGAUGGGU$_{C_{G-5'}}$   (SEQ ID NO: 845)

CKAP5-4091 Target: 5'-GAACCGGATGTGCCTTGTCTACCCAGC-3' (SEQ ID NO: 1421)

5'-ACCGGAUGUGCCUUGUCUACCCAGC$_C$$^{C-3'}$   (SEQ ID NO: 3150)

3'-UGGCCUACACGGAACAGAUGGGUCG$_{A_{A-5'}}$   (SEQ ID NO: 846)

CKAP5-4093 Target: 5'-ACCGGATGTGCCTTGTCTACCCAGCTA-3' (SEQ ID NO: 1422)

5'-CGGAUGUGCCUUGUCUACCCAGCUA$_A$$^{A-3'}$   (SEQ ID NO: 3151)

3'-GCCUACACGGAACAGAUGGGUCGAU$_{C_{G-5'}}$   (SEQ ID NO: 847)

CKAP5-4095 Target: 5'-CGGATGTGCCTTGTCTACCCAGCTAGC-3' (SEQ ID NO: 1423)

TABLE 5-continued

Selected Human Anti-CKAP5 "Blunt/Fray" DsiRNAs

5'-GAUGUGCCUUGUCUACCCAGCUAGC$_C{}^{C-3'}$ (SEQ ID NO: 3152)

3'-CUACACGGAACAGAUGGGUCGAUCG$_U{}_{A-5'}$ (SEQ ID NO: 848)

CKAP5-4097 Target: 5'-GATGTGCCTTGTCTACCCAGCTAGCAA-3' (SEQ ID NO: 1424)

5'-AUCCAAAAACUCUAAGCAGAGAGCA$_A{}^{C-3'}$ (SEQ ID NO: 3153)

3'-UAGGUUUUUGAGAUUCGUCUCUCGU$_C{}_{A-5'}$ (SEQ ID NO: 849)

CKAP5-4154 Target: 5'-ATCCAAAAACTCTAAGCAGAGAGCAGA-3' (SEQ ID NO: 1425)

5'-CCAAAAACUCUAAGCAGAGAGCAGA$_A{}^{C-3'}$ (SEQ ID NO: 3154)

3'-GGUUUUUGAGAUUCGUCUCUCGUCU$_C{}_{A-5'}$ (SEQ ID NO: 850)

CKAP5-4156 Target: 5'-CCAAAAACTCTAAGCAGAGAGCAGAGT-3' (SEQ ID NO: 1426)

5'-AAAAACUCUAAGCAGAGAGCAGAGU$_A{}^{A-3'}$ (SEQ ID NO: 3155)

3'-UUUUUGAGAUUCGUCUCUCGUCUCA$_C{}_{G-5'}$ (SEQ ID NO: 851)

CKAP5-4158 Target: 5'-AAAAACTCTAAGCAGAGAGCAGAGTGC-3' (SEQ ID NO: 1427)

5'-AAACUCUAAGCAGAGAGCAGAGUGC$_A{}^{C-3'}$ (SEQ ID NO: 3156)

3'-UUUGAGAUUCGUCUCUCGUCUCACG$_G{}_{A-5'}$ (SEQ ID NO: 852)

CKAP5-4160 Target: 5'-AAACTCTAAGCAGAGAGCAGAGTGCCT-3' (SEQ ID NO: 1428)

5'-ACUCUAAGCAGAGAGCAGAGUGCCU$_A{}^{A-3'}$ (SEQ ID NO: 3157)

3'-UGAGAUUCGUCUCUCGUCUCACGGA$_C{}_{C-5'}$ (SEQ ID NO: 853)

CKAP5-4162 Target: 5'-ACTCTAAGCAGAGAGCAGAGTGCCTGG-3' (SEQ ID NO: 1429)

5'-UCUAAGCAGAGAGCAGAGUGCCUGG$_C{}^{C-3'}$ (SEQ ID NO: 3158)

3'-AGAUUCGUCUCUCGUCUCACGGACC$_U{}_{A-5'}$ (SEQ ID NO: 854)

CKAP5-4164 Target: 5'-TCTAAGCAGAGAGCAGAGTGCCTGGAA-3' (SEQ ID NO: 1430)

5'-UAAGCAGAGAGCAGAGUGCCUGGAA$_A{}^{C-3'}$ (SEQ ID NO: 3159)

3'-AUUCGUCUCUCGUCUCACGGACCUU$_C{}_{A-5'}$ (SEQ ID NO: 855)

CKAP5-4166 Target: 5'-TAAGCAGAGAGCAGAGTGCCTGGAAGA-3' (SEQ ID NO: 1431)

TABLE 5-continued

Selected Human Anti-CKAP5 "Blunt/Fray" DsiRNAs

5'-AGCAGAGAGCAGAGUGCCUGGAAGA$_A$$^{A-3'}$ (SEQ ID NO: 3160)

3'-UCGUCUCUCGUCUCACGGACCUUCU$_C$$_{G-5'}$ (SEQ ID NO: 856)

CKAP5-4168 Target: 5'-AGCAGAGAGCAGAGTGCCTGGAAGAGC-3' (SEQ ID NO: 1432)

5'-CAGAGAGCAGAGUGCCUGGAAGAGC$_C$$^{A-3'}$ (SEQ ID NO: 3161)

3'-GUCUCUCGUCUCACGGACCUUCUCG$_A$$_{C-5'}$ (SEQ ID NO: 857)

CKAP5-4170 Target: 5'-CAGAGAGCAGAGTGCCTGGAAGAGCTG-3' (SEQ ID NO: 1433)

5'-GAGAGCAGAGUGCCUGGAAGAGCUG$_A$$^{A-3'}$ (SEQ ID NO: 3162)

3'-CUCUCGUCUCACGGACCUUCUCGAC$_C$$_{C-5'}$ (SEQ ID NO: 858)

CKAP5-4172 Target: 5'-GAGAGCAGAGTGCCTGGAAGAGCTGGG-3' (SEQ ID NO: 1434)

5'-GAGCAGAGUGCCUGGAAGAGCUGGG$_C$$^{C-3'}$ (SEQ ID NO: 3163)

3'-CUCGUCUCACGGACCUUCUCGACCC$_U$$_{A-5'}$ (SEQ ID NO: 859)

CKAP5-4174 Target: 5'-GAGCAGAGTGCCTGGAAGAGCTGGGAT-3' (SEQ ID NO: 1435)

5'-CCCAGGAAAAGCCUUAAAGGAAAUA$_A$$^{A-3'}$ (SEQ ID NO: 3164)

3'-GGGUCCUUUUCGGAAUUUCCUUUAU$_C$$_{G-5'}$ (SEQ ID NO: 860)

CKAP5-4241 Target: 5'-CCCAGGAAAAGCCTTAAAGGAAATAGC-3' (SEQ ID NO: 1436)

5'-GGAUCAGGUGUUCAAACUGAUUGGA$_C$$^{C-3'}$ (SEQ ID NO: 3165)

3'-CCUAGUCCACAAGUUUGACUAACCU$_U$$_{A-5'}$ (SEQ ID NO: 861)

CKAP5-4346 Target: 5'-GGATCAGGTGTTCAAACTGATTGGAAA-3' (SEQ ID NO: 1437)

5'-AUCAGGUGUUCAAACUGAUUGGAAA$_C$$^{A-3'}$ (SEQ ID NO: 3166)

3'-UAGUCCACAAGUUUGACUAACCUUU$_A$$_{G-5'}$ (SEQ ID NO: 862)

CKAP5-4348 Target: 5'-ATCAGGTGTTCAAACTGATTGGAAATC-3' (SEQ ID NO: 1438)

5'-CAGGUGUUCAAACUGAUUGGAAAUC$_C$$^{C-3'}$ (SEQ ID NO: 3167)

3'-GUCCACAAGUUUGACUAACCUUUAG$_A$$_{A-5'}$ (SEQ ID NO: 863)

CKAP5-4350 Target: 5'-CAGGTGTTCAAACTGATTGGAAATCTT-3' (SEQ ID NO: 1439)

TABLE 5-continued

Selected Human Anti-CKAP5 "Blunt/Fray" DsiRNAs

5'-GGUGUUCAAACUGAUUGGAAAUCUU$_C^{A-3'}$ (SEQ ID NO: 3168)

3'-CCACAAGUUUGACUAACCUUUAGAA$_A{}_{G-5'}$ (SEQ ID NO: 864)

CKAP5-4352 Target: 5'-GGTGTTCAAACTGATTGGAAATCTTTC-3' (SEQ ID NO: 1440)

5'-UGUUCAAACUGAUUGGAAAUCUUUC$_C^{A-3'}$ (SEQ ID NO: 3169)

3'-ACAAGUUUGACUAACCUUUAGAAAG$_A{}_{C-5'}$ (SEQ ID NO: 865)

CKAP5-4354 Target: 5'-TGTTCAAACTGATTGGAAATCTTTCTG-3' (SEQ ID NO: 1441)

5'-UUCAAACUGAUUGGAAAUCUUUCUG$_C^{C-3'}$ (SEQ ID NO: 3170)

3'-AAGUUUGACUAACCUUUAGAAAGAC$_U{}_{A-5'}$ (SEQ ID NO: 866)

CKAP5-4356 Target: 5'-TTCAAACTGATTGGAAATCTTTCTGAA-3' (SEQ ID NO: 1442)

5'-CAAACUGAUUGGAAAUCUUUCUGAA$_C^{C-3'}$ (SEQ ID NO: 3171)

3'-GUUUGACUAACCUUUAGAAAGACUU$_U{}_{A-5'}$ (SEQ ID NO: 867)

CKAP5-4358 Target: 5'-CAAACTGATTGGAAATCTTTCTGAAAA-3' (SEQ ID NO: 1443)

5'-AACUGAUUGGAAAUCUUUCUGAAAA$_A^{A-3'}$ (SEQ ID NO: 3172)

3'-UUGACUAACCUUUAGAAAGACUUUU$_C{}_{C-5'}$ (SEQ ID NO: 868)

CKAP5-4360 Target: 5'-AACTGATTGGAAATCTTTCTGAAAAGG-3' (SEQ ID NO: 1444)

5'-UUAAGCGGUCAGCAAAGAGACCCUC$_C^{A-3'}$ (SEQ ID NO: 3173)

3'-AAUUCGCCAGUCGUUUCUCUGGGAG$_A{}_{C-5'}$ (SEQ ID NO: 869)

CKAP5-4411 Target: 5'-TTAAGCGGTCAGCAAAGAGACCCTCTG-3' (SEQ ID NO: 1445)

5'-AAGCGGUCAGCAAAGAGACCCUCUG$_A^{C-3'}$ (SEQ ID NO: 3174)

3'-UUCGCCAGUCGUUUCUCUGGGAGAC$_G{}_{A-5'}$ (SEQ ID NO: 870)

CKAP5-4413 Target: 5'-AAGCGGTCAGCAAAGAGACCCTCTGCT-3' (SEQ ID NO: 1446)

5'-GCGGUCAGCAAAGAGACCCUCUGCU$_A^{A-3'}$ (SEQ ID NO: 3175)

3'-CGCCAGUCGUUUCUCUGGGAGACGA$_C{}_{G-5'}$ (SEQ ID NO: 871)

CKAP5-4415 Target: 5'-GCGGTCAGCAAAGAGACCCTCTGCTGC-3' (SEQ ID NO: 1447)

TABLE 5-continued

Selected Human Anti-CKAP5 "Blunt/Fray" DsiRNAs

5'-GGUCAGCAAAGAGACCCUCUGCUGC$_C^{A-3'}$  (SEQ ID NO: 3176)

3'-CCAGUCGUUUCUCUGGGAGACGACG$_U{_{G-5'}}$  (SEQ ID NO: 872)

CKAP5-4417 Target: 5'-GGTCAGCAAAGAGACCCTCTGCTGCAC-3' (SEQ ID NO: 1448)

5'-UCAGCAAAGAGACCCUCUGCUGCAC$_A^{A-3'}$  (SEQ ID NO: 3177)

3'-AGUCGUUUCUCUGGGAGACGACGUG$_G{_{A-5'}}$  (SEQ ID NO: 873)

CKAP5-4419 Target: 5'-TCAGCAAAGAGACCCTCTGCTGCACCA-3' (SEQ ID NO: 1449)

5'-AGCAAAGAGACCCUCUGCUGCACCA$_C^{C-3'}$  (SEQ ID NO: 3178)

3'-UCGUUUCUCUGGGAGACGACGUGGU$_U{_{A-5'}}$  (SEQ ID NO: 874)

CKAP5-4421 Target: 5'-AGCAAAGAGACCCTCTGCTGCACCAAT-3' (SEQ ID NO: 1450)

5'-CAAAGAGACCCUCUGCUGCACCAAU$_C^{C-3'}$  (SEQ ID NO: 3179)

3'-GUUUCUCUGGGAGACGACGUGGUUA$_U{_{A-5'}}$  (SEQ ID NO: 875)

CKAP5-4423 Target: 5'-CAAAGAGACCCTCTGCTGCACCAATAA-3' (SEQ ID NO: 1451)

5'-GUUACGCAAGGGACCAGCUGAGGAC$_C^{C-3'}$  (SEQ ID NO: 3180)

3'-CAAUGCGUUCCCUGGUCGACUCCUG$_U{_{A-5'}}$  (SEQ ID NO: 876)

CKAP5-4505 Target: 5'-GTTACGCAAGGGACCAGCTGAGGACAT-3' (SEQ ID NO: 1452)

5'-UACGCAAGGGACCAGCUGAGGACAU$_A^{C-3'}$  (SEQ ID NO: 3181)

3'-AUGCGUUCCCUGGUCGACUCCUGUA$_C{_{A-5'}}$  (SEQ ID NO: 877)

CKAP5-4507 Target: 5'-TACGCAAGGGACCAGCTGAGGACATGT-3' (SEQ ID NO: 1453)

5'-UCCGCCGAGAAUUCCAGCUGGAUCU$_C^{A-3'}$  (SEQ ID NO: 3182)

3'-AGGCGGCUCUUAAGGUCGACCUAGA$_U{_{C-5'}}$  (SEQ ID NO: 878)

CKAP5-4591 Target: 5'-TCCGCCGAGAATTCCAGCTGGATCTAG-3' (SEQ ID NO: 1454)

5'-CGCCGAGAAUUCCAGCUGGAUCUAG$_C^{C-3'}$  (SEQ ID NO: 3183)

3'-GCGGCUCUUAAGGUCGACCUAGAUC$_U{_{A-5'}}$  (SEQ ID NO: 879)

CKAP5-4593 Target: 5'-CGCCGAGAATTCCAGCTGGATCTAGAT-3' (SEQ ID NO: 1455)

TABLE 5-continued

Selected Human Anti-CKAP5 "Blunt/Fray" DsiRNAs

5'-CAAGAUCCGGGCUGUUUCUCCACAC$_C$$^{C-3'}$ (SEQ ID NO: 3184)

3'-GUUCUAGGCCCGACAAAGAGGUGUG$_A$$_{A-5'}$ (SEQ ID NO: 880)

CKAP5-4718 Target: 5'-CAAGATCCGGGCTGTTTCTCCACACTT-3' (SEQ ID NO: 1456)

5'-AGAUCCGGGCUGUUUCUCCACACUU$_A$$^{A-3'}$ (SEQ ID NO: 3185)

3'-UCUAGGCCCGACAAAGAGGUGUGAA$_G$$_{C-5'}$ (SEQ ID NO: 881)

CKAP5-4720 Target: 5'-AGATCCGGGCTGTTTCTCCACACTTCG-3' (SEQ ID NO: 1457)

5'-UCGAUGACAUGCACAGUAAUACAGC$_C$$^{C-3'}$ (SEQ ID NO: 3186)

3'-AGCUACUGUACGUGUCAUUAUGUCG$_U$$_{A-5'}$ (SEQ ID NO: 882)

CKAP5-4744 Target: 5'-TCGATGACATGCACAGTAATACAGCAT-3' (SEQ ID NO: 1458)

5'-GAUGACAUGCACAGUAAUACAGCAU$_A$$^{A-3'}$ (SEQ ID NO: 3187)

3'-CUACUGUACGUGUCAUUAUGUCGUA$_G$$_{G-5'}$ (SEQ ID NO: 883)

CKAP5-4746 Target: 5'-GATGACATGCACAGTAATACAGCATCC-3' (SEQ ID NO: 1459)

5'-UGACAUGCACAGUAAUACAGCAUCC$_C$$^{A-3'}$ (SEQ ID NO: 3188)

3'-ACUGUACGUGUCAUUAUGUCGUAGG$_U$$_{G-5'}$ (SEQ ID NO: 884)

CKAP5-4748 Target: 5'-TGACATGCACAGTAATACAGCATCCAC-3' (SEQ ID NO: 1460)

5'-ACAUGCACAGUAAUACAGCAUCCAC$_C$$^{C-3'}$ (SEQ ID NO: 3189)

3'-UGUACGUGUCAUUAUGUCGUAGGUG$_U$$_{A-5'}$ (SEQ ID NO: 885)

CKAP5-4750 Target: 5'-ACATGCACAGTAATACAGCATCCACAA-3' (SEQ ID NO: 1461)

5'-AUGCACAGUAAUACAGCAUCCACAA$_C$$^{A-3'}$ (SEQ ID NO: 3190)

3'-UACGUGUCAUUAUGUCGUAGGUGUU$_A$$_{G-5'}$ (SEQ ID NO: 886)

CKAP5-4752 Target: 5'-ATGCACAGTAATACAGCATCCACAATC-3' (SEQ ID NO: 1462)

5'-GCACAGUAAUACAGCAUCCACAAUC$_C$$^{C-3'}$ (SEQ ID NO: 3191)

3'-CGUGUCAUUAUGUCGUAGGUGUUAG$_U$$_{A-5'}$ (SEQ ID NO: 887)

CKAP5-4754 Target: 5'-GCACAGTAATACAGCATCCACAATCAA-3' (SEQ ID NO: 1463)

TABLE 5-continued

Selected Human Anti-CKAP5 "Blunt/Fray" DsiRNAs

5'-ACAGUAAUACAGCAUCCACAAUCAA$_C$$^{C-3'}$ (SEQ ID NO: 3192)

3'-UGUCAUUAUGUCGUAGGUGUUAGUU$_A$$_{A-5'}$ (SEQ ID NO: 888)

CKAP5-4756 Target: 5'-ACAGTAATACAGCATCCACAATCAATT-3' (SEQ ID NO: 1464)

5'-AGUAAUACAGCAUCCACAAUCAAUU$_C$$^{A-3'}$ (SEQ ID NO: 3193)

3'-UCAUUAUGUCGUAGGUGUUAGUUAA$_A$$_{G-5'}$ (SEQ ID NO: 889)

CKAP5-4758 Target: 5'-AGTAATACAGCATCCACAATCAATTTC-3' (SEQ ID NO: 1465)

5'-UAAUACAGCAUCCACAAUCAAUUUC$_C$$^{C-3'}$ (SEQ ID NO: 3194)

3'-AUUAUGUCGUAGGUGUUAGUUAAAG$_U$$_{A-5'}$ (SEQ ID NO: 890)

CKAP5-4760 Target: 5'-TAATACAGCATCCACAATCAATTTCAT-3' (SEQ ID NO: 1466)

5'-AUACAGCAUCCACAAUCAAUUUCAU$_C$$^{C-3'}$ (SEQ ID NO: 3195)

3'-UAUGUCGUAGGUGUUAGUUAAAGUA$_A$$_{A-5'}$ (SEQ ID NO: 891)

CKAP5-4762 Target: 5'-ATACAGCATCCACAATCAATTTCATTA-3' (SEQ ID NO: 1467)

5'-ACAGCAUCCACAAUCAAUUUCAUUA$_C$$^{C-3'}$ (SEQ ID NO: 3196)

3'-UGUCGUAGGUGUUAGUUAAAGUAAU$_A$$_{G-5'}$ (SEQ ID NO: 892)

CKAP5-4764 Target: 5'-ACAGCATCCACAATCAATTTCATTATC-3' (SEQ ID NO: 1468)

5'-AGCAUCCACAAUCAAUUUCAUUAUC$_C$$^{A-3'}$ (SEQ ID NO: 3197)

3'-UCGUAGGUGUUAGUUAAAGUAAUAG$_A$$_{G-5'}$ (SEQ ID NO: 893)

CKAP5-4766 Target: 5'-AGCATCCACAATCAATTTCATTATCTC-3' (SEQ ID NO: 1469)

5'-CAUCCACAAUCAAUUUCAUUAUCUC$_A$$^{A-3'}$ (SEQ ID NO: 3198)

3'-GUAGGUGUUAGUUAAAGUAAUAGAG$_G$$_{G-5'}$ (SEQ ID NO: 894)

CKAP5-4768 Target: 5'-CATCCACAATCAATTTCATTATCTCCC-3' (SEQ ID NO: 1470)

5'-UCCACAAUCAAUUUCAUUAUCUCCC$_C$$^{C-3'}$ (SEQ ID NO: 3199)

3'-AGGUGUUAGUUAAAGUAAUAGAGGG$_U$$_{A-5'}$ (SEQ ID NO: 895)

CKAP5-4770 Target: 5'-TCCACAATCAATTTCATTATCTCCCAA-3' (SEQ ID NO: 1471)

TABLE 5-continued

Selected Human Anti-CKAP5 "Blunt/Fray" DsiRNAs

5'-CACAAUCAAUUUCAUUAUCUCCCAA$^{A}$$^{C-3'}$ (SEQ ID NO: 3200)

3'-GUGUUAGUUAAAGUAAUAGAGGGUU$_{C}$$_{A-5'}$ (SEQ ID NO: 896)

CKAP5-4772 Target: 5'-CACAATCAATTTCATTATCTCCCAAGT-3' (SEQ ID NO: 1472)

5'-CAAUCAAUUUCAUUAUCUCCCAAGU$^{C}$$^{A-3'}$ (SEQ ID NO: 3201)

3'-GUUAGUUAAAGUAAUAGAGGGUUCA$_{U}$$_{C-5'}$ (SEQ ID NO: 897)

CKAP5-4774 Target: 5'-CAATCAATTTCATTATCTCCCAAGTAG-3' (SEQ ID NO: 1473)

5'-AUCAAUUUCAUUAUCUCCCAAGUAG$^{A}$$^{A-3'}$ (SEQ ID NO: 3202)

3'-UAGUUAAAGUAAUAGAGGGUUCAUC$_{G}$$_{G-5'}$ (SEQ ID NO: 898)

CKAP5-4776 Target: 5'-ATCAATTTCATTATCTCCCAAGTAGCC-3' (SEQ ID NO: 1474)

5'-CAAUUUCAUUAUCUCCCAAGUAGCC$^{C}$$^{A-3'}$ (SEQ ID NO: 3203)

3'-GUUAAAGUAAUAGAGGGUUCAUCGG$_{U}$$_{C-5'}$ (SEQ ID NO: 899)

CKAP5-4778 Target: 5'-CAATTTCATTATCTCCCAAGTAGCCAG-3' (SEQ ID NO: 1475)

5'-AUUUCAUUAUCUCCCAAGUAGCCAG$^{C}$$^{A-3'}$ (SEQ ID NO: 3204)

3'-UAAAGUAAUAGAGGGUUCAUCGGUC$_{A}$$_{C-5'}$ (SEQ ID NO: 900)

CKAP5-4780 Target: 5'-ATTTCATTATCTCCCAAGTAGCCAGTG-3' (SEQ ID NO: 1476)

5'-UUCAUUAUCUCCCAAGUAGCCAGUG$^{A}$$^{C-3'}$ (SEQ ID NO: 3205)

3'-AAGUAAUAGAGGGUUCAUCGGUCAC$_{C}$$_{A-5'}$ (SEQ ID NO: 901)

CKAP5-4782 Target: 5'-TTCATTATCTCCCAAGTAGCCAGTGGT-3' (SEQ ID NO: 1477)

5'-CAUUAUCUCCCAAGUAGCCAGUGGU$^{A}$$^{C-3'}$ (SEQ ID NO: 3206)

3'-GUAAUAGAGGGUUCAUCGGUCACCA$_{C}$$_{A-5'}$ (SEQ ID NO: 902)

CKAP5-4784 Target: 5'-CATTATCTCCCAAGTAGCCAGTGGTGA-3' (SEQ ID NO: 1478)

5'-UUAUCUCCCAAGUAGCCAGUGGUGA$^{A}$$^{C-3'}$ (SEQ ID NO: 3207)

3'-AAUAGAGGGUUCAUCGGUCACCACU$_{G}$$_{A-5'}$ (SEQ ID NO: 903)

CKAP5-4786 Target: 5'-TTATCTCCCAAGTAGCCAGTGGTGACA-3' (SEQ ID NO: 1479)

TABLE 5-continued

Selected Human Anti-CKAP5 "Blunt/Fray" DsiRNAs

5'-AUCUCCCAAGUAGCCAGUGGUGACA$_\text{C}$$^{\text{A-3'}}$ (SEQ ID NO: 3208)

3'-UAGAGGGUUCAUCGGUCACCACUGU$_\text{A}$$_\text{G-5'}$ (SEQ ID NO: 904)

CKAP5-4788 Target: 5'-ATCTCCCAAGTAGCCAGTGGTGACATC-3' (SEQ ID NO: 1480)

5'-CUCCCAAGUAGCCAGUGGUGACAUC$_\text{C}$$^{\text{C-3'}}$ (SEQ ID NO: 3209)

3'-GAGGGUUCAUCGGUCACCACUGUAG$_\text{U}$$_\text{A-5'}$ (SEQ ID NO: 905)

CKAP5-4790 Target: 5'-CTCCCAAGTAGCCAGTGGTGACATCAA-3' (SEQ ID NO: 1481)

5'-CCCAAGUAGCCAGUGGUGACAUCAA$^{\text{A}}$$^{\text{C-3'}}$ (SEQ ID NO: 3210)

3'-GGGUUCAUCGGUCACCACUGUAGUU$_\text{G}$$_\text{A-5'}$ (SEQ ID NO: 906)

CKAP5-4792 Target: 5'-CCCAAGTAGCCAGTGGTGACATCAACA-3' (SEQ ID NO: 1482)

5'-UUGCCCGGGAGGCCUCCACUGGAGU$_\text{C}$$^{\text{A-3'}}$ (SEQ ID NO: 3211)

3'-AACGGGCCCUCCGGAGGUGACCUCA$_\text{U}$$_\text{G-5'}$ (SEQ ID NO: 907)

CKAP5-5041 Target: 5'-TTGCCCGGGAGGCCTCCACTGGAGTAC-3' (SEQ ID NO: 1483)

5'-GCCCGGGAGGCCUCCACUGGAGUAC$_\text{C}$$^{\text{C-3'}}$ (SEQ ID NO: 3212)

3'-CGGGCCCUCCGGAGGUGACCUCAUG$_\text{A}$$_\text{A-5'}$ (SEQ ID NO: 908)

CKAP5-5043 Target: 5'-GCCCGGGAGGCCTCCACTGGAGTACTA-3' (SEQ ID NO: 1484)

5'-CCGGGAGGCCUCCACUGGAGUACUA$_\text{C}$$^{\text{C-3'}}$ (SEQ ID NO: 3213)

3'-GGCCCUCCGGAGGUGACCUCAUGAU$_\text{U}$$_\text{A-5'}$ (SEQ ID NO: 909)

CKAP5-5045 Target: 5'-CCGGGAGGCCTCCACTGGAGTACTAAA-3' (SEQ ID NO: 1485)

5'-GGGAGGCCUCCACUGGAGUACUAAA$_\text{C}$$^{\text{A-3'}}$ (SEQ ID NO: 3214)

3'-CCCUCCGGAGGUGACCUCAUGAUUU$_\text{U}$$_\text{C-5'}$ (SEQ ID NO: 910)

CKAP5-5047 Target: 5'-GGGAGGCCTCCACTGGAGTACTAAAAG-3' (SEQ ID NO: 1486)

5'-UCAUCACCUUAAUGCUGAAUUCUCG$^{\text{A}}$$^{\text{C-3'}}$ (SEQ ID NO: 3215)

3'-AGUAGUGGAAUUACGACCUAAGAGC$_\text{C}$$_\text{A-5'}$ (SEQ ID NO: 911)

CKAP5-5089 Target: 5'-TCATCACCTTAATGCTGGATTCTCGGA-3' (SEQ ID NO: 1487)

TABLE 5-continued

Selected Human Anti-CKAP5 "Blunt/Fray" DsiRNAs

5'-AUCACCUUAAUGCUGAAUUCUCGGA$_C{}^{C-3'}$ (SEQ ID NO: 3216)

3'-UAGUGGAAUUACGACCUAAGAGCCU$_A{}_{A-5'}$ (SEQ ID NO: 912)

CKAP5-5091 Target: 5'-ATCACCTTAATGCTGGATTCTCGGATT-3' (SEQ ID NO: 1488)

5'-CACCUUAAUGCUGAAUUCUCGGAUU$_A{}^{C-3'}$ (SEQ ID NO: 3217)

3'-GUGGAAUUACGACCUAAGAGCCUAA$_C{}_{A-5'}$ (SEQ ID NO: 913)

CKAP5-5093 Target: 5'-CACCTTAATGCTGGATTCTCGGATTGA-3' (SEQ ID NO: 1489)

5'-CCUUAAUGCUGAAUUCUCGGAUUGA$_C{}^{A-3'}$ (SEQ ID NO: 3218)

3'-GGAAUUACGACCUAAGAGCCUAACU$_U{}_{C-5'}$ (SEQ ID NO: 914)

CKAP5-5095 Target: 5'-CCTTAATGCTGGATTCTCGGATTGAAG-3' (SEQ ID NO: 1490)

5'-UUAAUGCUGAAUUCUCGGAUUGAAG$_C{}^{C-3'}$ (SEQ ID NO: 3219)

3'-AAUUACGACCUAAGAGCCUAACUUC$_U{}_{A-5'}$ (SEQ ID NO: 915)

CKAP5-5097 Target: 5'-TTAATGCTGGATTCTCGGATTGAAGAT-3' (SEQ ID NO: 1491)

5'-AAUGCUGAAUUCUCGGAUUGAAGAU$_A{}^{C-3'}$ (SEQ ID NO: 3220)

3'-UUACGACCUAAGAGCCUAACUUCUA$_G{}_{A-5'}$ (SEQ ID NO: 916)

CKAP5-5099 Target: 5'-AATGCTGGATTCTCGGATTGAAGATCT-3' (SEQ ID NO: 1492)

5'-UGCUGAAUUCUCGGAUUGAAGAUCU$_C{}^{A-3'}$ (SEQ ID NO: 3221)

3'-ACGACCUAAGAGCCUAACUUCUAGA$_A{}_{C-5'}$ (SEQ ID NO: 917)

CKAP5-5101 Target: 5'-TGCTGGATTCTCGGATTGAAGATCTTG-3' (SEQ ID NO: 1493)

5'-CUGAAUUCUCGGAUUGAAGAUCUUG$_C{}^{A-3'}$ (SEQ ID NO: 3222)

3'-GACCUAAGAGCCUAACUUCUAGAAC$_U{}_{C-5'}$ (SEQ ID NO: 918)

CKAP5-5103 Target: 5'-CTGGATTCTCGGATTGAAGATCTTGAG-3' (SEQ ID NO: 1494)

5'-GGAUUCUCGGAUUGAAGAUCUUGAG$_A{}^{C-3'}$ (SEQ ID NO: 3223)

3'-CCUAAGAGCCUAACUUCUAGAACUC$_C{}_{A-5'}$ (SEQ ID NO: 919)

CKAP5-5105 Target: 5'-GGATTCTCGGATTGAAGATCTTGAGGA-3' (SEQ ID NO: 1495)

TABLE 5-continued

Selected Human Anti-CKAP5 "Blunt/Fray" DsiRNAs

5'-CUCUGUGAACCUCUUGGUGGUGAAG$_A$$^{AC-3'}$ (SEQ ID NO: 3224)

3'-GAGACACUUGGAGAACCACCACUUC$_C$$_{A-5'}$ (SEQ ID NO: 920)

CKAP5-5150 Target: 5'-CTCTGTGAACCTCTTGGTGGTGAAGGT-3' (SEQ ID NO: 1496)

5'-CUGUGAACCUCUUGGUGGUGAAGGU$_C$$^{A-3'}$ (SEQ ID NO: 3225)

3'-GACACUUGGAGAACCACCACUUCCA$_A$$_{G-5'}$ (SEQ ID NO: 921)

CKAP5-5152 Target: 5'-CTGTGAACCTCTTGGTGGTGAAGGTTC-3' (SEQ ID NO: 1497)

5'-GUGAACCUCUUGGUGGUGAAGGUUC$_C$$^{A-3'}$ (SEQ ID NO: 3226)

3'-CACUUGGAGAACCACCACUUCCAAG$_A$$_{C-5'}$ (SEQ ID NO: 922)

CKAP5-5154 Target: 5'-GTGAACCTCTTGGTGGTGAAGGTTCTG-3' (SEQ ID NO: 1498)

5'-GAACCUCUUGGUGGUGAAGGUUCUG$_A$$^{C-3'}$ (SEQ ID NO: 3227)

3'-CUUGGAGAACCACCACUUCCAAGAC$_C$$_{A-5'}$ (SEQ ID NO: 923)

CKAP5-5156 Target: 5'-GAACCTCTTGGTGGTGAAGGTTCTGGA-3' (SEQ ID NO: 1499)

5'-AAGACAGCCUGCUAGCAACAGCCAG$_C$$^{C-3'}$ (SEQ ID NO: 3228)

3'-UUCUGUCGGACGAUCGUUGUCGGUC$_A$$_{A-5'}$ (SEQ ID NO: 924)

CKAP5-5230 Target: 5'-AAGACAGCCTGCTAGCAACAGCCAGTT-3' (SEQ ID NO: 1500)

5'-CCAGUUCUCCCAAAUUCUCAGAGCU$_C$$^{A-3'}$ (SEQ ID NO: 3229)

3'-GGUCAAGAGGGUUUAAGAGUCUCGA$_A$$_{C-5'}$ (SEQ ID NO: 925)

CKAP5-5251 Target: 5'-CCAGTTCTCCCAAATTCTCAGAGCTTG-3' (SEQ ID NO: 1501)

5'-AGUUCUCCCAAAUUCUCAGAGCUUG$_C$$^{C-3'}$ (SEQ ID NO: 3230)

3'-UCAAGAGGGUUUAAGAGUCUCGAAC$_A$$_{A-5'}$ (SEQ ID NO: 926)

CKAP5-5253 Target: 5'-AGTTCTCCCAAATTCTCAGAGCTTGTT-3' (SEQ ID NO: 1502)

5'-UUCUCCCAAAUUCUCAGAGCUUGUU$_C$$^{C-3'}$ (SEQ ID NO: 3231)

3'-AAGAGGGUUUAAGAGUCUCGAACAA$_U$$_{A-5'}$ (SEQ ID NO: 927)

CKAP5-5255 Target: 5'-TTCTCCCAAATTCTCAGAGCTTGTTAT-3' (SEQ ID NO: 1503)

TABLE 5-continued

Selected Human Anti-CKAP5 "Blunt/Fray" DsiRNAs

```
                               A C-3'
5'-CUCCCAAAUUCUCAGAGCUUGUUAU          (SEQ ID NO: 3232)

3'-GAGGGUUUAAGAGUCUCGAACAAUA          (SEQ ID NO: 928)
                             C A-5'
```

CKAP5-5257 Target: 5'-CTCCCAAATTCTCAGAGCTTGTTATGA-3' (SEQ ID NO: 1504)

```
                              C A-3'
5'-CCCAAAUUCUCAGAGCUUGUUAUGA         (SEQ ID NO: 3233)

3'-GGGUUUAAGAGUCUCGAACAAUACU         (SEQ ID NO: 929)
                            U C-5'
```

CKAP5-5259 Target: 5'-CCCAAATTCTCAGAGCTTGTTATGAAG-3' (SEQ ID NO: 1505)

```
                              C A-3'
5'-CAAAUUCUCAGAGCUUGUUAUGAAG          (SEQ ID NO: 3234)

3'-GUUUAAGAGUCUCGAACAAUACUUC          (SEQ ID NO: 930)
                             A C-5'
```

CKAP5-5261 Target: 5'-CAAATTCTCAGAGCTTGTTATGAAGTG-3' (SEQ ID NO: 1506)

```
                              C A-3'
5'-AAUUCUCAGAGCUUGUUAUGAAGUG          (SEQ ID NO: 3235)

3'-UUAAGAGUCUCGAACAAUACUUCAC          (SEQ ID NO: 931)
                             A G-5'
```

CKAP5-5263 Target: 5'-AATTCTCAGAGCTTGTTATGAAGTGTC-3' (SEQ ID NO: 1507)

```
                              C A-3'
5'-UUCUCAGAGCUUGUUAUGAAGUGUC          (SEQ ID NO: 3236)

3'-AAGAGUCUCGAACAAUACUUCACAG          (SEQ ID NO: 932)
                             A G-5'
```

CKAP5-5265 Target: 5'-TTCTCAGAGCTTGTTATGAAGTGTCTC-3' (SEQ ID NO: 1508)

```
                              C A-3'
5'-CUCAGAGCUUGUUAUGAAGUGUCUC          (SEQ ID NO: 3237)

3'-GAGUCUCGAACAAUACUUCACAGAG          (SEQ ID NO: 933)
                             A C-5'
```

CKAP5-5267 Target: 5'-CTCAGAGCTTGTTATGAAGTGTCTCTG-3' (SEQ ID NO: 1509)

```
                              A C-3'
5'-CAGAGCUUGUUAUGAAGUGUCUCUG          (SEQ ID NO: 3238)

3'-GUCUCGAACAAUACUUCACAGAGAC          (SEQ ID NO: 934)
                             C A-5'
```

CKAP5-5269 Target: 5'-CAGAGCTTGTTATGAAGTGTCTCTGGA-3' (SEQ ID NO: 1510)

```
                              C A-3'
5'-AUAGCAUUAACCUAGACAGAAUUCU          (SEQ ID NO: 3239)

3'-UAUCGUAAUUGGAUCUGUCUUAAGA          (SEQ ID NO: 935)
                             A G-5'
```

CKAP5-5326 Target: 5'-ATAGCATTAACCTAGACAGAATTCTTC-3' (SEQ ID NO: 1511)

TABLE 5-continued

Selected Human Anti-CKAP5 "Blunt/Fray" DsiRNAs

5'-AGCAUUAACCUAGACAGAAUUCUUC$_C{}^{A\text{-}3'}$ (SEQ ID NO: 3240)

3'-UCGUAAUUGGAUCUGUCUUAAGAAG$_{A_{C\text{-}5'}}$ (SEQ ID NO: 936)

CKAP5-5328 Target: 5'-AGCATTAACCTAGACAGAATTCTTCTG-3' (SEQ ID NO: 1512)

5'-CAUUAACCUAGACAGAAUUCUUCUG$_A{}^{C\text{-}3'}$ (SEQ ID NO: 3241)

3'-GUAAUUGGAUCUGUCUUAAGAAGAC$_{C_{A\text{-}5'}}$ (SEQ ID NO: 937)

CKAP5-5330 Target: 5'-CATTAACCTAGACAGAATTCTTCTGGA-3' (SEQ ID NO: 1513)

5'-UUAACCUAGACAGAAUUCUUCUGGA$_C{}^{C\text{-}3'}$ (SEQ ID NO: 3242)

3'-AAUUGGAUCUGUCUUAAGAAGACCU$_{A_{A\text{-}5'}}$ (SEQ ID NO: 938)

CKAP5-5332 Target: 5'-TTAACCTAGACAGAATTCTTCTGGATA-3' (SEQ ID NO: 1514)

5'-AACCUAGACAGAAUUCUUCUGGAUA$_C{}^{A\text{-}3'}$ (SEQ ID NO: 3243)

3'-UUGGAUCUGUCUUAAGAAGACCUAU$_{A_{G\text{-}5'}}$ (SEQ ID NO: 939)

CKAP5-5334 Target: 5'-AACCTAGACAGAATTCTTCTGGATATC-3' (SEQ ID NO: 1515)

5'-CCUAGACAGAAUUCUUCUGGAUAUC$_A{}^{C\text{-}3'}$ (SEQ ID NO: 3244)

3'-GGAUCUGUCUUAAGAAGACCUAUAG$_{G_{A\text{-}5'}}$ (SEQ ID NO: 940)

CKAP5-5336 Target: 5'-CCTAGACAGAATTCTTCTGGATATCCA-3' (SEQ ID NO: 1516)

5'-UAGACAGAAUUCUUCUGGAUAUCUC$_A{}^{A\text{-}3'}$ (SEQ ID NO: 3245)

3'-AUAGGUGUAAAAGUACUUCCAGAAG$_{G_{G\text{-}5'}}$ (SEQ ID NO: 941)

CKAP5-5357 Target: 5'-TATCCACATTTTCATGAAGGTCTTCCC-3' (SEQ ID NO: 1517)

5'-CUGAAGCAAUGCAAAAGUGAAUUUC$_A{}^{A\text{-}3'}$ (SEQ ID NO: 3246)

3'-GACUUCGUUACGUUUUCACUUAAAG$_{G_{G\text{-}5'}}$ (SEQ ID NO: 942)

CKAP5-5394 Target: 5'-CTGAAGCAATGCAAAAGTGAATTTCCC-3' (SEQ ID NO: 1518)

5'-GAAGCAAUGCAAAAGUGAAUUUCCC$_C{}^{C\text{-}3'}$ (SEQ ID NO: 3247)

3'-CUUCGUUACGUUUUCACUUAAAGGG$_{U_{A\text{-}5'}}$ (SEQ ID NO: 943)

CKAP5-5396 Target: 5'-GAAGCAATGCAAAAGTGAATTTCCCAT-3' (SEQ ID NO: 1519)

TABLE 5-continued

Selected Human Anti-CKAP5 "Blunt/Fray" DsiRNAs

5'-AGCAAUGCAAAAGUGAAUUUCCCAU$_C$$^{C-3'}_C$ (SEQ ID NO: 3248)

3'-UCGUUACGUUUUCACUUAAAGGGUA$_U$$_{A-5'}$ (SEQ ID NO: 944)

CKAP5-5398 Target: 5'-AGCAATGCAAAAGTGAATTTCCCATAA-3' (SEQ ID NO: 1520)

5'-ACAGUAUGGACCAGACUGGGAGCAA$_A$$^{C-3'}$ (SEQ ID NO: 3249)

3'-UGUCAUACCUGGUCUGACCCUCGUU$_C$$_{A-5'}$ (SEQ ID NO: 945)

CKAP5-5551 Target: 5'-ACAGTATGGACCAGACTGGGAGCAAGT-3' (SEQ ID NO: 1521)

5'-AGUAUGGACCAGACUGGGAGCAAGU$_A$$^{C-3'}$ (SEQ ID NO: 3250)

3'-UCAUACCUGGUCUGACCCUCGUUCA$_G$$_{A-5'}$ (SEQ ID NO: 946)

CKAP5-5553 Target: 5'-AGTATGGACCAGACTGGGAGCAAGTCT-3' (SEQ ID NO: 1522)

5'-UAUGGACCAGACUGGGAGCAAGUCU$_A$$^{C-3'}$ (SEQ ID NO: 3251)

3'-AUACCUGGUCUGACCCUCGUUCAGA$_C$$_{A-5'}$ (SEQ ID NO: 947)

CKAP5-5555 Target: 5'-TATGGACCAGACTGGGAGCAAGTCTGA-3' (SEQ ID NO: 1523)

5'-UGGACCAGACUGGGAGCAAGUCUGA$_C$$^{C-3'}_C$ (SEQ ID NO: 3252)

3'-ACCUGGUCUGACCCUCGUUCAGACU$_A$$_{A-5'}$ (SEQ ID NO: 948)

CKAP5-5557 Target: 5'-TGGACCAGACTGGGAGCAAGTCTGATA-3' (SEQ ID NO: 1524)

5'-GACCAGACUGGGAGCAAGUCUGAUA$_C$$^{A-3'}$ (SEQ ID NO: 3253)

3'-CUGGUCUGACCCUCGUUCAGACUAU$_U$$_{C-5'}$ (SEQ ID NO: 949)

CKAP5-5559 Target: 5'-GACCAGACTGGGAGCAAGTCTGATAAG-3' (SEQ ID NO: 1525)

5'-CCAGACUGGGAGCAAGUCUGAUAAG$_A$$^{C-3'}$ (SEQ ID NO: 3254)

3'-GGUCUGACCCUCGUUCAGACUAUUC$_C$$_{A-5'}$ (SEQ ID NO: 950)

CKAP5-5561 Target: 5'-CCAGACTGGGAGCAAGTCTGATAAGGA-3' (SEQ ID NO: 1526)

5'-AGACUGGGAGCAAGUCUGAUAAGGA$_C$$^{C-3'}_C$ (SEQ ID NO: 3255)

3'-UCUGACCCUCGUUCAGACUAUUCCU$_U$$_{A-5'}$ (SEQ ID NO: 951)

CKAP5-5563 Target: 5'-AGACTGGGAGCAAGTCTGATAAGGAAA-3' (SEQ ID NO: 1527)

TABLE 5-continued

Selected Human Anti-CKAP5 "Blunt/Fray" DsiRNAs

5'-ACUGGGAGCAAGUCUGAUAAGGAAA$_A{}^{C-3'}$  (SEQ ID NO: 3256)

3'-UGACCCUCGUUCAGACUAUUCCUUU$_G{}_{A-5'}$  (SEQ ID NO: 952)

CKAP5-5565 Target: 5'-ACTGGGAGCAAGTCTGATAAGGAAACA-3'  (SEQ ID NO: 1528)

5'-UGGGAGCAAGUCUGAUAAGGAAACA$^{C-3'}$  (SEQ ID NO: 3257)

3'-ACCCUCGUUCAGACUAUUCCUUUGU$_C{}_{A-5'}$  (SEQ ID NO: 953)

CKAP5-5567 Target: 5'-TGGGAGCAAGTCTGATAAGGAAACAGA-3'  (SEQ ID NO: 1529)

5'-GGAGCAAGUCUGAUAAGGAAACAGA$_C{}^{C-3'}$  (SEQ ID NO: 3258)

3'-CCUCGUUCAGACUAUUCCUUUGUCU$_U{}_{A-5'}$  (SEQ ID NO: 954)

CKAP5-5569 Target: 5'-GGAGCAAGTCTGATAAGGAAACAGAAA-3'  (SEQ ID NO: 1530)

5'-AGCAAGUCUGAUAAGGAAACAGAAA$_C{}^{A-3'}$  (SEQ ID NO: 3259)

3'-UCGUUCAGACUAUUCCUUUGUCUUU$_U{}_{C-5'}$  (SEQ ID NO: 955)

CKAP5-5571 Target: 5'-AGCAAGTCTGATAAGGAAACAGAAAG-3'  (SEQ ID NO: 1531)

5'-CAAGUCUGAUAAGGAAACAGAAAAG$_A{}^{A-3'}$  (SEQ ID NO: 3260)

3'-GUUCAGACUAUUCCUUUGUCUUUUC$_C{}_{C-5'}$  (SEQ ID NO: 956)

CKAP5-5573 Target: 5'-CAAGTCTGATAAGGAAACAGAAAAGGG-3'  (SEQ ID NO: 1532)

5'-AGUCUGAUAAGGAAACAGAAAAGGG$_C{}^{A-3'}$  (SEQ ID NO: 3261)

3'-UCAGACUAUUCCUUUGUCUUUUCCC$_U{}_{C-5'}$  (SEQ ID NO: 957)

CKAP5-5575 Target: 5'-AGTCTGATAAGGAAACAGAAAAGGGAG-3'  (SEQ ID NO: 1533)

5'-UCUGAUAAGGAAACAGAAAAGGGAG$_A{}^{C-3'}$  (SEQ ID NO: 3262)

3'-AGACUAUUCCUUUGUCUUUUCCCUC$_G{}_{A-5'}$  (SEQ ID NO: 958)

CKAP5-5577 Target: 5'-TCTGATAAGGAAACAGAAAAGGGAGCA-3'  (SEQ ID NO: 1534)

5'-UGAUAAGGAAACAGAAAAGGGAGCA$_C{}^{A-3'}$  (SEQ ID NO: 3263)

3'-ACUAUUCCUUUGUCUUUUCCCUCGU$_A{}_{G-5'}$  (SEQ ID NO: 959)

CKAP5-5579 Target: 5'-TGATAAGGAAACAGAAAAGGGAGCATC-3'  (SEQ ID NO: 1535)

TABLE 5-continued

Selected Human Anti-CKAP5 "Blunt/Fray" DsiRNAs

5'-AUAAGGAAACAGAAAAGGGAGCAUC$_C^{A-3'}$A   (SEQ ID NO: 3264)

3'-UAUUCCUUUGUCUUUUCCCUCGUAG$_A{_{G-5'}}$   (SEQ ID NO: 960)

CKAP5-5581 Target: 5'-ATAAGGAAACAGAAAAGGGAGCATCTC-3' (SEQ ID NO: 1536)

5'-CAUCUCGAAUAGAUGAAAAAUCAUC$_C^{C-3'}$C   (SEQ ID NO: 3265)

3'-GUAGAGCUUAUCUACUUUUUAGUAG$_U{_{A-5'}}$   (SEQ ID NO: 961)

CKAP5-5602 Target: 5'-CATCTCGAATAGATGAAAAATCATCAA-3' (SEQ ID NO: 1537)

5'-UCUCGAAUAGAUGAAAAAUCAUCAA$_A^{C-3'}$   (SEQ ID NO: 3266)

3'-AGAGCUUAUCUACUUUUUAGUAGUU$_U{_{C-5'}}$   (SEQ ID NO: 962)

CKAP5-5604 Target: 5'-TCTCGAATAGATGAAAAATCATCAAAG-3' (SEQ ID NO: 1538)

5'-UCGAAUAGAUGAAAAAUCAUCAAAG$_A^{A-3'}$   (SEQ ID NO: 3267)

3'-AGCUUAUCUACUUUUUAGUAGUUUC$_C{_{G-5'}}$   (SEQ ID NO: 963)

CKAP5-5606 Target: 5'-TCGAATAGATGAAAAATCATCAAAGGC-3' (SEQ ID NO: 1539)

5'-GAAUAGAUGAAAAAUCAUCAAAGGC$_A^{C-3'}$   (SEQ ID NO: 3268)

3'-CUUAUCUACUUUUUAGUAGUUUCCG$_G{_{A-5'}}$   (SEQ ID NO: 964)

CKAP5-5608 Target: 5'-GAATAGATGAAAAATCATCAAAGGCCA-3' (SEQ ID NO: 1540)

5'-AUAGAUGAAAAAUCAUCAAAGGCCA$_C^{C-3'}$   (SEQ ID NO: 3269)

3'-UAUCUACUUUUUAGUAGUUUCCGGU$_U{_{A-5'}}$   (SEQ ID NO: 965)

CKAP5-5610 Target: 5'-ATAGATGAAAAATCATCAAAGGCCAAA-3' (SEQ ID NO: 1541)

5'-AGAUGAAAAAUCAUCAAAGGCCAAA$_A^{C-3'}$   (SEQ ID NO: 3270)

3'-UCUACUUUUUAGUAGUUUCCGGUUU$_C{_{A-5'}}$   (SEQ ID NO: 966)

CKAP5-5612 Target: 5'-AGATGAAAAATCATCAAAGGCCAAAGT-3' (SEQ ID NO: 1542)

5'-AUGAAAAAUCAUCAAAGGCCAAAGU$_A^{C-3'}$   (SEQ ID NO: 3271)

3'-UACUUUUUAGUAGUUUCCGGUUUCA$_C{_{A-5'}}$   (SEQ ID NO: 967)

CKAP5-5614 Target: 5'-ATGAAAAATCATCAAAGGCCAAAGTGA-3' (SEQ ID NO: 1543)

TABLE 5-continued

Selected Human Anti-CKAP5 "Blunt/Fray" DsiRNAs

5'-GAAAAAUCAUCAAAGGCCAAAGUGA$_C{}^{C\text{-}3'}$ (SEQ ID NO: 3272)

3'-CUUUUUAGUAGUUUCCGGUUUCACU$_U{}_{A\text{-}5'}$ (SEQ ID NO: 968)

CKAP5-5616 Target: 5'-GAAAAATCATCAAAGGCCAAAGTGAAT-3' (SEQ ID NO: 1544)

5'-AAAAUCAUCAAAGGCCAAAGUGAAU$_A{}^{C\text{-}3'}$ (SEQ ID NO: 3273)

3'-UUUUAGUAGUUUCCGGUUUCACUUA$_C{}_{A\text{-}5'}$ (SEQ ID NO: 969)

CKAP5-5618 Target: 5'-AAAATCATCAAAGGCCAAAGTGAATGA-3' (SEQ ID NO: 1545)

5'-GAAUGAUUUCUUAGCUGAGAUUUUU$_C{}^{C\text{-}3'}$ (SEQ ID NO: 3274)

3'-CUUACUAAAGAAUCGACUCUAAAAA$_U{}_{A\text{-}5'}$ (SEQ ID NO: 970)

CKAP5-5639 Target: 5'-GAATGATTTCTTAGCTGAGATTTTAA-3' (SEQ ID NO: 1546)

5'-AUGAUUUCUUAGCUGAGAUUUUUAA$_A{}^{C\text{-}3'}$ (SEQ ID NO: 3275)

3'-UACUAAAGAAUCGACUCUAAAAAUU$_C{}_{A\text{-}5'}$ (SEQ ID NO: 971)

CKAP5-5641 Target: 5'-ATGATTTCTTAGCTGAGATTTTAAGA-3' (SEQ ID NO: 1547)

5'-GAUUUCUUAGCUGAGAUUUUUAAGA$_C{}^{A\text{-}3'}$ (SEQ ID NO: 3276)

3'-CUAAAGAAUCGACUCUAAAAAUUCU$_U{}_{C\text{-}5'}$ (SEQ ID NO: 972)

CKAP5-5643 Target: 5'-GATTTCTTAGCTGAGATTTTAAGAAG-3' (SEQ ID NO: 1548)

5'-UUUCUUAGCUGAGAUUUUUAAGAAG$_C{}^{C\text{-}3'}$ (SEQ ID NO: 3277)

3'-AAAGAAUCGACUCUAAAAAUUCUUC$_U{}_{A\text{-}5'}$ (SEQ ID NO: 973)

CKAP5-5645 Target: 5'-TTTCTTAGCTGAGATTTTAAGAAGAT-3' (SEQ ID NO: 1549)

5'-UCUUAGCUGAGAUUUUUAAGAAGAU$_C{}^{A\text{-}3'}$ (SEQ ID NO: 3278)

3'-AGAAUCGACUCUAAAAAUUCUUCUA$_A{}_{C\text{-}5'}$ (SEQ ID NO: 974)

CKAP5-5647 Target: 5'-TCTTAGCTGAGATTTTTAAGAAGATTG-3' (SEQ ID NO: 1550)

5'-UUAGCUGAGAUUUUUAAGAAGAUUG$_A{}^{A\text{-}3'}$ (SEQ ID NO: 3279)

3'-AAUCGACUCUAAAAAUUCUUCUAAC$_C{}_{G\text{-}5'}$ (SEQ ID NO: 975)

CKAP5-5649 Target: 5'-TTAGCTGAGATTTTTAAGAAGATTGGC-3' (SEQ ID NO: 1551)

TABLE 5-continued

Selected Human Anti-CKAP5 "Blunt/Fray" DsiRNAs

5'-AGCUGAGAUUUUUAAGAAGAUUGGC$_C{}^{A-3'}$ (SEQ ID NO: 3280)

3'-UCGACUCUAAAAAUUCUUCUAACCG$_A{}_{G-5'}$ (SEQ ID NO: 976)

CKAP5-5651 Target: 5'-AGCTGAGATTTTTAAGAAGATTGGCTC-3' (SEQ ID NO: 1552)

5'-CUGAGAUUUUUAAGAAGAUUGGCUC$_C{}^{C-3'}$ (SEQ ID NO: 3281)

3'-GACUCUAAAAAUUCUUCUAACCGAG$_A{}_{A-5'}$ (SEQ ID NO: 977)

CKAP5-5653 Target: 5'-CTGAGATTTTTAAGAAGATTGGCTCTA-3' (SEQ ID NO: 1553)

5'-GAGAUUUUUAAGAAGAUUGGCUCUA$_C{}^{C-3'}$ (SEQ ID NO: 3282)

3'-CUCUAAAAAUUCUUCUAACCGAGAU$_U{}_{A-5'}$ (SEQ ID NO: 978)

CKAP5-5655 Target: 5'-GAGATTTTTAAGAAGATTGGCTCTAAA-3' (SEQ ID NO: 1554)

5'-GAUUUUUAAGAAGAUUGGCUCUAAA$_A{}^{C-3'}$ (SEQ ID NO: 3283)

3'-CUAAAAAUUCUUCUAACCGAGAUUU$_C{}_{A-5'}$ (SEQ ID NO: 979)

CKAP5-5657 Target: 5'-GATTTTTAAGAAGATTGGCTCTAAAGA-3' (SEQ ID NO: 1555)

5'-ACUAGCAGAGUUAUAUGAAUAUAAG$_C{}^{C-3'}$ (SEQ ID NO: 3284)

3'-UGAUCGUCUCAAUAUACUUAUAUUC$_U{}_{A-5'}$ (SEQ ID NO: 980)

CKAP5-5699 Target: 5'-ACTAGCAGAGTTATATGAATATAAGAA-3' (SEQ ID NO: 1556)

5'-UAGCAGAGUUAUAUGAAUAUAAGAA$_A{}^{C-3'}$ (SEQ ID NO: 3285)

3'-AUCGUCUCAAUAUACUUAUAUUCUU$_C{}_{A-5'}$ (SEQ ID NO: 981)

CKAP5-5701 Target: 5'-TAGCAGAGTTATATGAATATAAGAAGA-3' (SEQ ID NO: 1557)

5'-GCAGAGUUAUAUGAAUAUAAGAAGA$_C{}^{C-3'}$ (SEQ ID NO: 3286)

3'-CGUCUCAAUAUACUUAUAUUCUUCU$_U{}_{A-5'}$ (SEQ ID NO: 982)

CKAP5-5703 Target: 5'-GCAGAGTTATATGAATATAAGAAGAAA-3' (SEQ ID NO: 1558)

5'-AGAGUUAUAUGAAUAUAAGAAGAAA$_C{}^{C-3'}$ (SEQ ID NO: 3287)

3'-UCUCAAUAUACUUAUAUUCUUCUUU$_A{}_{A-5'}$ (SEQ ID NO: 983)

CKAP5-5705 Target: 5'-AGAGTTATATGAATATAAGAAGAAATA-3' (SEQ ID NO: 1559)

TABLE 5-continued

Selected Human Anti-CKAP5 "Blunt/Fray" DsiRNAs

5'-AGUUAUAUGAAUAUAAGAAGAAAUA$_A{}^{C-3'}$ (SEQ ID NO: 3288)

3'-UCAAUAUACUUAUAUUCUUCUUUAU$_{G_{A-5'}}$ (SEQ ID NO: 984)

CKAP5-5707 Target: 5'-AGTTATATGAATATAAGAAGAAATACT-3' (SEQ ID NO: 1560)

5'-UUAUAUGAAUAUAAGAAGAAAUACU$_A{}^{C-3'}$ (SEQ ID NO: 3289)

3'-AAUAUACUUAUAUUCUUCUUUAUGA$_{G_{A-5'}}$ (SEQ ID NO: 985)

CKAP5-5709 Target: 5'-TTATATGAATATAAGAAGAAATACTCA-3' (SEQ ID NO: 1561)

5'-AUAUGAAUAUAAGAAGAAAUACUCA$_A{}^{C-3'}$ (SEQ ID NO: 3290)

3'-UAUACUUAUAUUCUUCUUUAUGAGU$_{C_{A-5'}}$ (SEQ ID NO: 986)

CKAP5-5711 Target: 5'-ATATGAATATAAGAAGAAATACTCAGA-3' (SEQ ID NO: 1562)

5'-GCUGACAUUGAACCAUUUCUGAAAA$_C{}^{C-3'}$ (SEQ ID NO: 3291)

3'-CGACUGUAACUUGGUAAAGACUUUU$_{U_{A-5'}}$ (SEQ ID NO: 987)

CKAP5-5739 Target: 5'-GCTGACATTGAACCATTTCTGAAAAAT-3' (SEQ ID NO: 1563)

5'-UGACAUUGAACCAUUUCUGAAAAAU$_C{}^{A-3'}$ (SEQ ID NO: 3292)

3'-ACUGUAACUUGGUAAAGACUUUUUA$_{A_{G-5'}}$ (SEQ ID NO: 988)

CKAP5-5741 Target: 5'-TGACATTGAACCATTTCTGAAAAATTC-3' (SEQ ID NO: 1564)

5'-ACAUUGAACCAUUUCUGAAAAAUUC$_A{}^{C-3'}$ (SEQ ID NO: 3293)

3'-UGUAACUUGGUAAAGACUUUUUAAG$_{G_{A-5'}}$ (SEQ ID NO: 989)

CKAP5-5743 Target: 5'-ACATTGAACCATTTCTGAAAAATTCCT-3' (SEQ ID NO: 1565)

5'-AUUGAACCAUUUCUGAAAAAUUCCU$_A{}^{C-3'}$ (SEQ ID NO: 3294)

3'-UAACUUGGUAAAGACUUUUUAAGGA$_{G_{A-5'}}$ (SEQ ID NO: 990)

CKAP5-5745 Target: 5'-ATTGAACCATTTCTGAAAAATTCCTCA-3' (SEQ ID NO: 1566)

5'-UGAACCAUUUCUGAAAAAUUCCUCA$_A{}^{C-3'}$ (SEQ ID NO: 3295)

3'-ACUUGGUAAAGACUUUUUAAGGAGU$_{G_{A-5'}}$ (SEQ ID NO: 991)

CKAP5-5747 Target: 5'-TGAACCATTTCTGAAAAATTCCTCACA-3' (SEQ ID NO: 1567)

TABLE 5-continued

Selected Human Anti-CKAP5 "Blunt/Fray" DsiRNAs

5'-AACCAUUUCUGAAAAAUUCCUCACA$_A{}^{AC-3'}$ (SEQ ID NO: 3296)

3'-UUGGUAAAGACUUUUUAAGGAGUGU$_C{}_{A-5'}$ (SEQ ID NO: 992)

CKAP5-5749 Target: 5'-AACCATTTCTGAAAAATTCCTCACAGT-3' (SEQ ID NO: 1568)

5'-AAAGAGGCCUUCGGGUGAUUGAGAU$_A{}^{A-3'}$ (SEQ ID NO: 3297)

3'-UUUCUCCGGAAGCCCACUAACUCUA$_C{}_{C-5'}$ (SEQ ID NO: 993)

CKAP5-5794 Target: 5'-AAAGAGGCCTTCGGGTGATTGAGATGG-3' (SEQ ID NO: 1569)

5'-AGAGGCCUUCGGGUGAUUGAGAUGG$_C{}^{A-3'}$ (SEQ ID NO: 3298)

3'-UCUCCGGAAGCCCACUAACUCUACC$_U{}_{C-5'}$ (SEQ ID NO: 994)

CKAP5-5796 Target: 5'-AGAGGCCTTCGGGTGATTGAGATGGAG-3' (SEQ ID NO: 1570)

5'-AGGCCUUCGGGUGAUUGAGAUGGAG$_C{}^{A-3'}$ (SEQ ID NO: 3299)

3'-UCCGGAAGCCCACUAACUCUACCUC$_U{}_{C-5'}$ (SEQ ID NO: 995)

CKAP5-5798 Target: 5'-AGGCCTTCGGGTGATTGAGATGGAGAG-3' (SEQ ID NO: 1571)

5'-GCCUUCGGGUGAUUGAGAUGGAGAG$_A{}^{A-3'}$ (SEQ ID NO: 3300)

3'-CGGAAGCCCACUAACUCUACCUCUC$_C{}_{C-5'}$ (SEQ ID NO: 996)

CKAP5-5800 Target: 5'-GCCTTCGGGTGATTGAGATGGAGAGGG-3' (SEQ ID NO: 1572)

5'-CUUCGGGUGAUUGAGAUGGAGAGGG$_C{}^{A-3'}$ (SEQ ID NO: 3301)

3'-GAAGCCCACUAACUCUACCUCUCCC$_U{}_{C-5'}$ (SEQ ID NO: 997)

CKAP5-5802 Target: 5'-CTTCGGGTGATTGAGATGGAGAGGGAG-3' (SEQ ID NO: 1573)

5'-UCGGGUGAUUGAGAUGGAGAGGGAG$_A{}^{A-3'}$ (SEQ ID NO: 3302)

3'-AGCCCACUAACUCUACCUCUCCCUC$_C{}_{C-5'}$ (SEQ ID NO: 998)

CKAP5-5804 Target: 5'-TCGGGTGATTGAGATGGAGAGGGAGGG-3' (SEQ ID NO: 1574)

5'-GGCCAUCUGUCUACUUGGAAAGGCU$_C{}^{C-3'}$ (SEQ ID NO: 3303)

3'-CCGGUAGACAGAUGAACCUUUCCGA$_U{}_{A-5'}$ (SEQ ID NO: 999)

CKAP5-5944 Target: 5'-GGCCATCTGTCTACTTGGAAAGGCTAA-3' (SEQ ID NO: 1575)

TABLE 5-continued

Selected Human Anti-CKAP5 "Blunt/Fray" DsiRNAs

5'-CCAUCUGUCUACUUGGAAAGGCUAA$_C{}^{A-3'}$ (SEQ ID NO: 3304)

3'-GGUAGACAGAUGAACCUUUCCGAUU$_U{}_{C-5'}$ (SEQ ID NO: 1000)

CKAP5-5946 Target: 5'-CCATCTGTCTACTTGGAAAGGCTAAAG-3' (SEQ ID NO: 1576)

5'-AUCUGUCUACUUGGAAAGGCUAAAG$_C{}^{C-3'}$ (SEQ ID NO: 3305)

3'-UAGACAGAUGAACCUUUCCGAUUUC$_U{}_{A-5'}$ (SEQ ID NO: 1001)

CKAP5-5948 Target: 5'-ATCTGTCTACTTGGAAAGGCTAAAGAT-3' (SEQ ID NO: 1577)

5'-CUGUCUACUUGGAAAGGCUAAAGAU$_A{}^{A-3'}$ (SEQ ID NO: 3306)

3'-GACAGAUGAACCUUUCCGAUUUCUA$_G{}_{G-5'}$ (SEQ ID NO: 1002)

CKAP5-5950 Target: 5'-CTGTCTACTTGGAAAGGCTAAAGATCC-3' (SEQ ID NO: 1578)

5'-UUUGACCUCUUUGCUCUCCAAACCA$_A{}^{A-3'}$ (SEQ ID NO: 3307)

3'-AAACUGGAGAAACGAGAGGUUUGGU$_C{}_{G-5'}$ (SEQ ID NO: 1003)

CKAP5-6026 Target: 5'-TTTGACCTCTTTGCTCTCCAAACCAGC-3' (SEQ ID NO: 1579)

5'-UGACCUCUUUGCUCUCCAAACCAGC$_C{}^{A-3'}$ (SEQ ID NO: 3308)

3'-ACUGGAGAAACGAGAGGUUUGGUCG$_U{}_{C-5'}$ (SEQ ID NO: 1004)

CKAP5-6028 Target: 5'-TGACCTCTTTGCTCTCCAAACCAGCAG-3' (SEQ ID NO: 1580)

5'-ACCUCUUUGCUCUCCAAACCAGCAG$_C{}^{C-3'}$ (SEQ ID NO: 3309)

3'-UGGAGAAACGAGAGGUUUGGUCGUC$_A{}_{A-5'}$ (SEQ ID NO: 1005)

CKAP5-6030 Target: 5'-ACCTCTTTGCTCTCCAAACCAGCAGTT-3' (SEQ ID NO: 1581)

5'-CUCUUUGCUCUCCAAACCAGCAGUU$_A{}^{A-3'}$ (SEQ ID NO: 3310)

3'-GAGAAACGAGAGGUUUGGUCGUCAA$_G{}_{G-5'}$ (SEQ ID NO: 1006)

CKAP5-6032 Target: 5'-CTCTTTGCTCTCCAAACCAGCAGTTCC-3' (SEQ ID NO: 1582)

5'-UGUGACCUCCUCCUCCUCCACAGCU$_C{}^{C-3'}$ (SEQ ID NO: 3311)

3'-ACACUGGAGGAGGAGGAGGUGUCGA$_U{}_{A-5'}$ (SEQ ID NO: 1007)

CKAP5-6173 Target: 5'-TGTGACCTCCTCCTCCTCCACAGCTAA-3' (SEQ ID NO: 1583)

TABLE 5-continued

Selected Human Anti-CKAP5 "Blunt/Fray" DsiRNAs

5'-AAAGACUGGAGAGAAUAAAGAGCAG$_C{}^{A-3'}$ (SEQ ID NO: 3312)

3'-UUUCUGACCUCUCUUAUUUCUCGUC$_A{}_{G-5'}$ (SEQ ID NO: 1008)

CKAP5-6217 Target: 5'-AAAGACTGGAGAGAATAAAGAGCAGTC-3' (SEQ ID NO: 1584)

5'-AGACUGGAGAGAAUAAAGAGCAGUC$_A{}^{A-3'}$ (SEQ ID NO: 3313)

3'-UCGACCUCUCUUAUUUCUCGUCAG$_C{}_{G-5'}$ (SEQ ID NO: 1009)

CKAP5-6219 Target: 5'-AGACTGGAGAGAATAAAGAGCAGTCGC-3' (SEQ ID NO: 1585)

5'-ACUGGAGAGAAUAAAGAGCAGUCGC$_C{}^{C-3'}$ (SEQ ID NO: 3314)

3'-UGACCUCUCUUAUUUCUCGUCAGCG$_U{}_{A-5'}$ (SEQ ID NO: 1010)

CKAP5-6221 Target: 5'-ACTGGAGAGAATAAAGAGCAGTCGCAA-3' (SEQ ID NO: 1586)

5'-UGGAGAGAAUAAAGAGCAGUCGCAA$_C{}^{C-3'}$ (SEQ ID NO: 3315)

3'-ACCUCUCUUAUUUCUCGUCAGCGUU$_U{}_{A-5'}$ (SEQ ID NO: 1011)

CKAP5-6223 Target: 5'-TGGAGAGAATAAAGAGCAGTCGCAAAT-3' (SEQ ID NO: 1587)

5'-GAGAGAAUAAAGAGCAGUCGCAAAU$_A{}^{C-3'}$ (SEQ ID NO: 3316)

3'-CUCUCUUAUUUCUCGUCAGCGUUUA$_C{}_{A-5'}$ (SEQ ID NO: 1012)

CKAP5-6225 Target: 5'-GAGAGAATAAAGAGCAGTCGCAAATGA-3' (SEQ ID NO: 1588)

5'-GAGAAUAAAGAGCAGUCGCAAAUGA$_C{}^{A-3'}$ (SEQ ID NO: 3317)

3'-CUCUUAUUUCUCGUCAGCGUUUACU$_U{}_{C-5'}$ (SEQ ID NO: 1013)

CKAP5-6227 Target: 5'-GAGAATAAAGAGCAGTCGCAAATGAAG-3' (SEQ ID NO: 1589)

5'-GAAUAAAGAGCAGUCGCAAAUGAAG$_A{}^{C-3'}$ (SEQ ID NO: 3318)

3'-CUUAUUUCUCGUCAGCGUUUACUUC$_G{}_{A-5'}$ (SEQ ID NO: 1014)

CKAP5-6229 Target: 5'-GAATAAAGAGCAGTCGCAAATGAAGCT-3' (SEQ ID NO: 1590)

5'-AUAAAGAGCAGUCGCAAAUGAAGCU$_A{}^{A-3'}$ (SEQ ID NO: 3319)

3'-UAUUUCUCGUCAGCGUUUACUUCGA$_C{}_{G-5'}$ (SEQ ID NO: 1015)

CKAP5-6231 Target: 5'-ATAAAGAGCAGTCGCAAATGAAGCTGC-3' (SEQ ID NO: 1591)

TABLE 5-continued

Selected Human Anti-CKAP5 "Blunt/Fray" DsiRNAs

5'-AAAGAGCAGUCGCAAAUGAAGCUGC$_A$$^{A-3'}_A$ (SEQ ID NO: 3320)

3'-UUUCUCGUCAGCGUUUACUUCGACG$_G$$_{G-5'}$ (SEQ ID NO: 1016)

CKAP5-6233 Target: 5'-AAAGAGCAGTCGCAAATGAAGCTGCCC-3' (SEQ ID NO: 1592)

5'-ACAAACUGGUUGUAUGUAUCAUGCC$_A$$^{C-3'}$ (SEQ ID NO: 3321)

3'-UGUUUGACCAACAUACAUAGUACGG$_C$$_{A-5'}$ (SEQ ID NO: 1017)

CKAP5-6342 Target: 5'-ACAAACTGGTTGTATGTATCATGCCGT-3' (SEQ ID NO: 1593)

5'-UGCUCAUUUGUAAAAUUGUCCUAAU$_A$$^{C-3'}$ (SEQ ID NO: 3322)

3'-ACGAGUAAACAUUUUAACAGGAUUA$_G$$_{A-5'}$ (SEQ ID NO: 1018)

CKAP5-6544 Target: 5'-TGCTCATTTGTAAAATTGTCCTAATCT-3' (SEQ ID NO: 1594)

5'-CUCAUUUGUAAAAUUGUCCUAAUCU$_C$$^{C-3'}$ (SEQ ID NO: 3323)

3'-GAGUAAACAUUUUAACAGGAUUAGA$_A$$_{A-5'}$ (SEQ ID NO: 1019)

CKAP5-6546 Target: 5'-CTCATTTGTAAAATTGTCCTAATCTTT-3' (SEQ ID NO: 1595)

5'-CAUUUGUAAAAUUGUCCUAAUCUUU$_A$$^{A-3'}$ (SEQ ID NO: 3324)

3'-GUAAACAUUUUAACAGGAUUAGAAA$_G$$_{G-5'}$ (SEQ ID NO: 1020)

CKAP5-6548 Target: 5'-CATTTGTAAAATTGTCCTAATCTTTCC-3' (SEQ ID NO: 1596)

5'-UCACUGUAUUCUGUAUGAAUGCAUG$_A$$^{A-3'}$ (SEQ ID NO: 3325)

3'-AGUGACAUAAGACAUACUUACGUAC$_C$$_{G-5'}$ (SEQ ID NO: 1021)

CKAP5-6656 Target: 5'-TCACTGTATTCTGTATGAATGCATGGC-3' (SEQ ID NO: 1597)

5'-ACUGUAUUCUGUAUGAAUGCAUGGC$_C$$^{C-3'}$ (SEQ ID NO: 3326)

3'-UGACAUAAGACAUACUUACGUACCG$_U$$_{A-5'}$ (SEQ ID NO: 1022)

CKAP5-6658 Target: 5'-ACTGTATTCTGTATGAATGCATGGCAT-3' (SEQ ID NO: 1598)

5'-UGUAUUCUGUAUGAAUGCAUGGCAU$_A$$^{C-3'}$ (SEQ ID NO: 3327)

3'-ACAUAAGACAUACUUACGUACCGUA$_C$$_{A-5'}$ (SEQ ID NO: 1023)

CKAP5-6660 Target: 5'-TGTATTCTGTATGAATGCATGGCATGA-3' (SEQ ID NO: 1599)

TABLE 5-continued

Selected Human Anti-CKAP5 "Blunt/Fray" DsiRNAs

5'-UAUUCUGUAUGAAUGCAUGGCAUGA$_C$$^{C-3'}$ (SEQ ID NO: 3328)

3'-AUAAGACAUACUUACGUACCGUACU$_A$$_{A-5'}$ (SEQ ID NO: 1024)

CKAP5-6662 Target: 5'-TATTCTGTATGAATGCATGGCATGATA-3' (SEQ ID NO: 1600)

5'-UUCUGUAUGAAUGCAUGGCAUGAUA$_A$$^{C-3'}$ (SEQ ID NO: 3329)

3'-AAGACAUACUUACGUACCGUACUAU$_G$$_{A-5'}$ (SEQ ID NO: 1025)

CKAP5-6664 Target: 5'-TTCTGTATGAATGCATGGCATGATACA-3' (SEQ ID NO: 1601)

5'-CUGUAUGAAUGCAUGGCAUGAUACA$_C$$^{A-3'}$ (SEQ ID NO: 3330)

3'-GACAUACUUACGUACCGUACUAUGU$_U$$_{G-5'}$ (SEQ ID NO: 1026)

CKAP5-6666 Target: 5'-CTGTATGAATGCATGGCATGATACAAC-3' (SEQ ID NO: 1602)

5'-UCUUUUAUAAAUAAAGUUUGCAUUA$_C$$^{A-3'}$ (SEQ ID NO: 3331)

3'-AGAAAAUAUUUAUUUCAAACGUAAU$_U$$_{G-5'}$ (SEQ ID NO: 1027)

CKAP5-6704 Target: 5'-TCTTTTATAAATAAAGTTTGCATTAAC-3' (SEQ ID NO: 1603)

5'-UUUUAUAAAUAAAGUUUGCAUUAAC$_C$$^{C-3'}$ (SEQ ID NO: 3332)

3'-AAAAUAUUUAUUUCAAACGUAAUUG$_U$$_{G-5'}$ (SEQ ID NO: 1028)

CKAP5-6706 Target: 5'-TTTTATAAATAAAGTTTGCATTAACTA-3' (SEQ ID NO: 1604)

5'-UUAUAAAUAAAGUUUGCAUUAACUA$_C$$^{C-3'}$ (SEQ ID NO: 3333)

3'-AAUAUUUAUUUCAAACGUAAUUGAU$_A$$_{A-5'}$ (SEQ ID NO: 1029)

CKAP5-6708 Target: 5'-TTATAAATAAAGTTTGCATTAACTATA-3' (SEQ ID NO: 1605)

5'-AUAAAUAAAGUUUGCAUUAACUAUA$_A$$^{A-3'}$ (SEQ ID NO: 3334)

3'-UAUUUAUUUCAAACGUAAUUGAUAU$_G$$_{G-5'}$ (SEQ ID NO: 1030)

CKAP5-6710 Target: 5'-ATAAATAAAGTTTGCATTAACTATACC-3' (SEQ ID NO: 1606)

5'-AAAUAAAGUUUGCAUUAACUAUACC$_C$$^{A-3'}$ (SEQ ID NO: 3335)

3'-UUUAUUUCAAACGUAAUUGAUAUGG$_A$$_{C-5'}$ (SEQ ID NO: 1031)

CKAP5-6712 Target: 5'-AAATAAAGTTTGCATTAACTATACCTG-3' (SEQ ID NO: 1607)

TABLE 5-continued

Selected Human Anti-CKAP5 "Blunt/Fray" DsiRNAs

5'-AUAAAGUUUGCAUUAACUAUACCUG$_C{}^{A-3'}$ (SEQ ID NO: 3336)

3'-UAUUUCAAACGUAAUUGAUAUGGAC$_U{}_{G-5'}$ (SEQ ID NO: 1032)

CKAP5-6714 Target: 5'-ATAAAGTTTGCATTAACTATACCTGAC-3' (SEQ ID NO: 1608)

5'-CCCAGCUGAGGAAAUACUCUUAAUU$_A{}^{C-3'}$ (SEQ ID NO: 3337)

3'-GGGUCGACUCCUUUAUGAGAAUUAA$_G{}_{A-5'}$ (SEQ ID NO: 1033)

CKAP5-106 Target: 5'-CCCAGCTGAGGAAATACTCTTAATTCT-3' (SEQ ID NO: 1609)

5'-GGUUGAAACUGCCAGUUGAUCAGAA$_C{}^{C-3'}$ (SEQ ID NO: 3338)

3'-CCAACUUUGACGGUCAACUAGUCUU$_U{}_{A-5'}$ (SEQ ID NO: 1034)

CKAP5-172 Target: 5'-GGTTGAAACTGCCAGTTGATCAGAAAT-3' (SEQ ID NO: 1610)

5'-CUGCCAGUUGAUCAGAAAUGUGAAC$_C{}^{A-3'}$ (SEQ ID NO: 3339)

3'-GACGGUCAACUAGUCUUUACACUUG$_U{}_{G-5'}$ (SEQ ID NO: 1035)

CKAP5-180 Target: 5'-CTGCCAGTTGATCAGAAATGTGAACAC-3' (SEQ ID NO: 1611)

5'-UGGAAAGCAAGGUUAAGUGGGUAUG$_C{}^{C-3'}$ (SEQ ID NO: 3340)

3'-ACCUUUCGUUCCAAUUCACCCAUAC$_U{}_{A-5'}$ (SEQ ID NO: 1036)

CKAP5-213 Target: 5'-TGGAAAGCAAGGTTAAGTGGGTATGAA-3' (SEQ ID NO: 1612)

5'-CCCAGAGUGGUCCAAAUUUUUAGGA$_C{}^{C-3'}$ (SEQ ID NO: 3341)

3'-GGGUCUCACCAGGUUUAAAAAUCCU$_A{}_{A-5'}$ (SEQ ID NO: 1037)

CKAP5-281 Target: 5'-CCCAGAGTGGTCCAAATTTTTAGGATT-3' (SEQ ID NO: 1613)

5'-CAGUGGUUCAAUUGAAAGGAUUAGA$_C{}^{A-3'}$ (SEQ ID NO: 3342)

3'-GUCACCAAGUUAACUUUCCUAAUCU$_U{}_{C-5'}$ (SEQ ID NO: 1038)

CKAP5-337 Target: 5'-CAGTGGTTCAATTGAAAGGATTAGAAG-3' (SEQ ID NO: 1614)

5'-AGGAUUAGAAGCUGCACUUGUUUAU$_A{}^{C-3'}$ (SEQ ID NO: 3343)

3'-UCCUAAUCUUCGACGUGAACAAAUA$_C{}_{A-5'}$ (SEQ ID NO: 1039)

CKAP5-353 Target: 5'-AGGATTAGAAGCTGCACTTGTTTATGT-3' (SEQ ID NO: 1615)

TABLE 5-continued

Selected Human Anti-CKAP5 "Blunt/Fray" DsiRNAs

5'-AGCUGCACUUGUUUAUGUUGAAAAU$_A$$^{A-3'}_A$ (SEQ ID NO: 3344)

3'-UCGACGUGAACAAAUACAACUUUUA$_C$$_{G-5'}$ (SEQ ID NO: 1040)

CKAP5-362 Target: 5'-AGCTGCACTTGTTTATGTTGAAAATGC-3' (SEQ ID NO: 1616)

5'-AGCAGGAAAAACCACAGGAGAAGUU$_A$$^{C-3'}$ (SEQ ID NO: 3345)

3'-UCGUCCUUUUUGGUGUCCUCUUCAA$_C$$_{A-5'}$ (SEQ ID NO: 1041)

CKAP5-395 Target: 5'-AGCAGGAAAAACCACAGGAGAAGTTGT-3' (SEQ ID NO: 1617)

5'-GUCAGGUGUUGUAAGUAAGGUGUUC$_C$$^{C-3'}$ (SEQ ID NO: 3346)

3'-CAGUCCACAACAUUCAUUCCACAAG$_U$$_{A-5'}$ (SEQ ID NO: 1042)

CKAP5-422 Target: 5'-GTCAGGTGTTGTAAGTAAGGTGTTCAA-3' (SEQ ID NO: 1618)

5'-GUGUUGUAAGUAAGGUGUUCAAUCA$_C$$^{A-3'}$ (SEQ ID NO: 3347)

3'-CACAACAUUCAUUCCACAAGUUAGU$_U$$_{G-5'}$ (SEQ ID NO: 1043)

CKAP5-427 Target: 5'-GTGTTGTAAGTAAGGTGTTCAATCAAC-3' (SEQ ID NO: 1619)

5'-GUUCAAUCAACCUAAAGCUAAAGCC$_C$$^{C-3'}$ (SEQ ID NO: 3348)

3'-CAAGUUAGUUGGAUUUCGAUUUCGG$_U$$_{A-5'}$ (SEQ ID NO: 1044)

CKAP5-443 Target: 5'-GTTCAATCAACCTAAAGCTAAAGCCAA-3' (SEQ ID NO: 1620)

5'-CUCCUGAAAGGCUUGGACAAUAAGA$_C$$^{C-3'}$ (SEQ ID NO: 3349)

3'-GAGGACUUUCCGAACCUGUUAUUCU$_U$$_{A-5'}$ (SEQ ID NO: 1045)

CKAP5-537 Target: 5'-CTCCTGAAAGGCTTGGACAATAAGAAT-3' (SEQ ID NO: 1621)

5'-UUAAGCCAAUUAUCAAAGUGUUGCC$_C$$^{C-3'}$ (SEQ ID NO: 3350)

3'-AAUUCGGUUAAUAGUUUCACAACGG$_U$$_{A-5'}$ (SEQ ID NO: 1046)

CKAP5-637 Target: 5'-TTAAGCCAATTATCAAAGTGTTGCCAA-3' (SEQ ID NO: 1622)

5'-UCAAAGUGUUGCCAAAACUCUUUGA$_A$$^{C-3'}$ (SEQ ID NO: 3351)

3'-AGUUUCACAACGGUUUUGAGAAACU$_C$$_{A-5'}$ (SEQ ID NO: 1047)

CKAP5-649 Target: 5'-TCAAAGTGTTGCCAAAACTCTTTGAGT-3' (SEQ ID NO: 1623)

TABLE 5-continued

Selected Human Anti-CKAP5 "Blunt/Fray" DsiRNAs

5'-GCCAAAACUCUUUGAGUCUCGAGAG$_C{}^{C-3'}$ (SEQ ID NO: 3352)

3'-CGGUUUUGAGAAACUCAGAGCUCUC$_U{}_{A-5'}$ (SEQ ID NO: 1048)

CKAP5-659 Target: 5'-GCCAAAACTCTTTGAGTCTCGAGAGAA-3' (SEQ ID NO: 1624)

5'-GGCUGUUCGAGAUGAAGCCAAACUA$_C{}^{C-3'}$ (SEQ ID NO: 3353)

3'-CCGACAAGCUCUACUUCGGUUUGAU$_U{}_{A-5'}$ (SEQ ID NO: 1049)

CKAP5-686 Target: 5'-GGCTGTTCGAGATGAAGCCAAACTAAT-3' (SEQ ID NO: 1625)

5'-CCCAUUACAAAAUAUAAACUCUGUU$_A{}^{C-3'}$ (SEQ ID NO: 3354)

3'-GGGUAAUGUUUUAUAUUUGAGACAA$_G{}_{A-5'}$ (SEQ ID NO: 1050)

CKAP5-755 Target: 5'-CCCATTACAAAATATAAACTCTGTTCA-3' (SEQ ID NO: 1626)

5'-ACAAAAUAUAAACUCUGUUCAGUUG$_C{}^{C-3'}$ (SEQ ID NO: 3355)

3'-UGUUUUAUAUUUGAGACAAGUCAAC$_U{}_{A-5'}$ (SEQ ID NO: 1051)

CKAP5-761 Target: 5'-ACAAAATATAAACTCTGTTCAGTTGAA-3' (SEQ ID NO: 1627)

5'-AUAUAAACUCUGUUCAGUUGAAAGA$_C{}^{A-3'}$ (SEQ ID NO: 3356)

3'-UAUAUUUGAGACAAGUCAACUUUCU$_U{}_{G-5'}$ (SEQ ID NO: 1052)

CKAP5-766 Target: 5'-ATATAAACTCTGTTCAGTTGAAAGAAC-3' (SEQ ID NO: 1628)

5'-CUCUGUUCAGUUGAAAGAACUAGAA$_A{}^{C-3'}$ (SEQ ID NO: 3357)

3'-GAGACAAGUCAACUUUCUUGAUCUU$_C{}_{A-5'}$ (SEQ ID NO: 1053)

CKAP5-773 Target: 5'-CTCTGTTCAGTTGAAAGAACTAGAAGA-3' (SEQ ID NO: 1629)

5'-GUGAUGAGGUGCCACAAAUAGAUGC$_C{}^{C-3'}$ (SEQ ID NO: 3358)

3'-CACUACUCCACGGUGUUUAUCUACG$_A{}_{A-5'}$ (SEQ ID NO: 1054)

CKAP5-928 Target: 5'-GTGATGAGGTGCCACAAATAGATGCTT-3' (SEQ ID NO: 1630)

5'-ACAAAUAGAUGCUUAUGAGCUUUUA$_A{}^{C-3'}$ (SEQ ID NO: 3359)

3'-UGUUUAUCUACGAAUACUCGAAAAU$_C{}_{A-5'}$ (SEQ ID NO: 1055)

CKAP5-941 Target: 5'-ACAAATAGATGCTTATGAGCTTTTAGA-3' (SEQ ID NO: 1631)

TABLE 5-continued

Selected Human Anti-CKAP5 "Blunt/Fray" DsiRNAs

5'-UUAUGAGCUUUUAGAAGCUGUAGAA$_C$$^{C-3'}$ (SEQ ID NO: 3360)

3'-AAUACUCGAAAAUCUUCGACAUCUU$_U$$_{A-5'}$ (SEQ ID NO: 1056)

CKAP5-953 Target: 5'-TTATGAGCTTTTAGAAGCTGTAGAAAT-3' (SEQ ID NO: 1632)

5'-GGCCCUGGAGUCUGUAGAAGUACUA$_C$$^{C-3'}$ (SEQ ID NO: 3361)

3'-CCGGGACCUCAGACAUCUUCAUGAU$_U$$_{A-5'}$ (SEQ ID NO: 1057)

CKAP5-1046 Target: 5'-GGCCCTGGAGTCTGTAGAAGTACTAAT-3' (SEQ ID NO: 1633)

5'-UGGAGUCUGUAGAAGUACUAAUAAA$_C$$^{C-3'}$ (SEQ ID NO: 3362)

3'-ACCUCAGACAUCUUCAUGAUUAUUU$_U$$_{A-5'}$ (SEQ ID NO: 1058)

CKAP5-1051 Target: 5'-TGGAGTCTGTAGAAGTACTAATAAAA-3' (SEQ ID NO: 1634)

5'-UGCAGAUUUAGUAAAAGCAUUAAAG$_C$$^{C-3'}$ (SEQ ID NO: 3363)

3'-ACGUCUAAAUCAUUUUCGUAAUUUC$_U$$_{A-5'}$ (SEQ ID NO: 1059)

CKAP5-1103 Target: 5'-TGCAGATTTAGTAAAAGCATTAAAGAA-3' (SEQ ID NO: 1635)

5'-GUAAAAGCAUUAAAGAAGGUUGUUG$_A$$^{C-3'}$ (SEQ ID NO: 3364)

3'-CAUUUUCGUAAUUUCUUCCAACAAC$_C$$_{A-5'}$ (SEQ ID NO: 1060)

CKAP5-1113 Target: 5'-GTAAAAGCATTAAAGAAGGTTGTTGGA-3' (SEQ ID NO: 1636)

5'-AGCAUUAAAGAAGGUUGUUGGAAAG$_A$$^{C-3'}$ (SEQ ID NO: 3365)

3'-UCGUAAUUUCUUCCAACAACCUUUC$_C$$_{A-5'}$ (SEQ ID NO: 1061)

CKAP5-1118 Target: 5'-AGCATTAAAGAAGGTTGTTGGAAAGGA-3' (SEQ ID NO: 1637)

5'-AAGAAGGUUGUUGGAAAGGACACCA$_C$$^{C-3'}$ (SEQ ID NO: 3366)

3'-UUCUUCCAACAACCUUUCCUGUGGU$_U$$_{A-5'}$ (SEQ ID NO: 1062)

CKAP5-1125 Target: 5'-AAGAAGGTTGTTGGAAAGGACACCAAT-3' (SEQ ID NO: 1638)

5'-AAGGAAGAAAUUUGGACAAUAUGCA$_A$$^{A-3'}$ (SEQ ID NO: 3367)

3'-UUCCUUCUUUAAACCUGUUAUACGU$_C$$_{C-5'}$ (SEQ ID NO: 1063)

CKAP5-1205 Target: 5'-AAGGAAGAAATTTGGACAATATGCAGG-3' (SEQ ID NO: 1639)

TABLE 5-continued

Selected Human Anti-CKAP5 "Blunt/Fray" DsiRNAs

5'-CAGUGAGGAUGUUUUAGCAGUAAUG$_A^{C-3'}$  (SEQ ID NO: 3368)

3'-GUCACUCCUACAAAAUCGUCAUUAC$_{A-5'}^{C}$  (SEQ ID NO: 1064)

CKAP5-1343 Target: 5'-CAGTGAGGATGTTTTAGCAGTAATGGA-3' (SEQ ID NO: 1640)

5'-AUGUUUUAGCAGUAAUGGAUAAUAA$_C^{C-3'}$  (SEQ ID NO: 3369)

3'-UACAAAAUCGUCAUUACCUAUUAUU$_{A-5'}^{U}$  (SEQ ID NO: 1065)

CKAP5-1351 Target: 5'-ATGTTTTAGCAGTAATGGATAATAAAA-3' (SEQ ID NO: 1641)

5'-AUCAAGCAGCAGACAUCUCUUUUUA$_C^{C-3'}$  (SEQ ID NO: 3370)

3'-UAGUUCGUCGUCUGUAGAGAAAAAU$_{A-5'}^{A}$  (SEQ ID NO: 1066)

CKAP5-1386 Target: 5'-ATCAAGCAGCAGACATCTCTTTTTATT-3' (SEQ ID NO: 1642)

5'-CAGACAUCUCUUUUUAUUGCAAGAA$_A^{C-3'}$  (SEQ ID NO: 3371)

3'-GUCUGUAGAGAAAAAUAACGUUCUU$_{A-5'}^{C}$  (SEQ ID NO: 1067)

CKAP5-1395 Target: 5'-CAGACATCTCTTTTTATTGCAAGAAGT-3' (SEQ ID NO: 1643)

5'-AGUCAGAGAUGCCGCAUUUGAAGCA$_C^{C-3'}$  (SEQ ID NO: 3372)

3'-UCAGUCUCUACGGCGUAAACUUCGU$_{A-5'}^{A}$  (SEQ ID NO: 1068)

CKAP5-1514 Target: 5'-AGTCAGAGATGCCGCATTTGAAGCATT-3' (SEQ ID NO: 1644)

5'-AGCAUUGGGUACUGCUUUGAAGGUG$_A^{C-3'}$  (SEQ ID NO: 3373)

3'-UCGUAACCCAUGACGAAACUUCCAC$_{A-5'}^{C}$  (SEQ ID NO: 1069)

CKAP5-1535 Target: 5'-AGCATTGGGTACTGCTTTGAAGGTGGT-3' (SEQ ID NO: 1645)

5'-AUGUGGACAAACUCAAGCUUGAUAA$_A^{C-3'}$  (SEQ ID NO: 3374)

3'-UACACCUGUUUGAGUUCGAACUAUU$_{A-5'}^{C}$  (SEQ ID NO: 1070)

CKAP5-1594 Target: 5'-ATGTGGACAAACTCAAGCTTGATAAGA-3' (SEQ ID NO: 1646)

5'-CAAAGAAUGUUCAGAAAAGGUAGAA$_A^{C-3'}$  (SEQ ID NO: 3375)

3'-GUUUCUUACAAGUCUUUUCCAUCUU$_{A-5'}^{G}$  (SEQ ID NO: 1071)

CKAP5-1622 Target: 5'-CAAAGAATGTTCAGAAAAGGTAGAACT-3' (SEQ ID NO: 1647)

TABLE 5-continued

Selected Human Anti-CKAP5 "Blunt/Fray" DsiRNAs

5'-GUUCAGAAAAGGUAGAACUGAUACAC$^{A-3'}$ (SEQ ID NO: 3376)

3'-CAAGUCUUUUCCAUCUUGACUAUGUA$_{C-5'}$ (SEQ ID NO: 1072)

CKAP5-1630 Target: 5'-GTTCAGAAAAGGTAGAACTGATACATG-3' (SEQ ID NO: 1648)

5'-AAGGUAGAACUGAUACAUGGUAAGAC$^{C-3'}$ (SEQ ID NO: 3377)

3'-UUCCAUCUUGACUAUGUACCAUUCUU$_{A-5'}$ (SEQ ID NO: 1073)

CKAP5-1638 Target: 5'-AAGGTAGAACTGATACATGGTAAGAAA-3' (SEQ ID NO: 1649)

5'-CGCAGGGAAUACUGGAACCAAGAACC$^{C-3'}$ (SEQ ID NO: 3378)

3'-GCGUCCCUUAUGACCUUGGUUCUUGU$_{A-5'}$ (SEQ ID NO: 1074)

CKAP5-1847 Target: 5'-CGCAGGGAATACTGGAACCAAGAACAA-3' (SEQ ID NO: 1650)

5'-AGCCUGAGCUCUCGAUAGAAGUAUGC$^{A-3'}$ (SEQ ID NO: 3379)

3'-UCGGACUCGAGAGCUAUCUUCAUACA$_{C-5'}$ (SEQ ID NO: 1075)

CKAP5-1903 Target: 5'-AGCCTGAGCTCTCGATAGAAGTATGTG-3' (SEQ ID NO: 1651)

5'-CUCGAUAGAAGUAUGUGAAGAAAAAA$^{A-3'}$ (SEQ ID NO: 3380)

3'-GAGCUAUCUUCAUACACUUCUUUUUC$_{G-5'}$ (SEQ ID NO: 1076)

CKAP5-1913 Target: 5'-CTCGATAGAAGTATGTGAAGAAAAAGC-3' (SEQ ID NO: 1652)

5'-UUCUUGACAGCAGUAACUGGAAAGAC$^{C-3'}$ (SEQ ID NO: 3381)

3'-AAGAACUGUCGUCAUUGACCUUUCUU$_{A-5'}$ (SEQ ID NO: 1077)

CKAP5-1972 Target: 5'-TTCTTGACAGCAGTAACTGGAAAGAAA-3' (SEQ ID NO: 1653)

5'-GAGCUAAUGGACCGAACUGAAAUGCA$^{C-3'}$ (SEQ ID NO: 3382)

3'-CUCGAUUACCUGGCUUGACUUUACGG$_{A-5'}$ (SEQ ID NO: 1078)

CKAP5-2034 Target: 5'-GAGCTAATGGACCGAACTGAAATGCCA-3' (SEQ ID NO: 1654)

5'-CAUUAGUGAGGAUGCUAGCCAAGAAC$^{A-3'}$ (SEQ ID NO: 3383)

3'-GUAAUCACUCCUACGAUCGGUUCUUU$_{G-5'}$ (SEQ ID NO: 1079)

CKAP5-2068 Target: 5'-CATTAGTGAGGATGCTAGCCAAGAAAC-3' (SEQ ID NO: 1655)

TABLE 5-continued

Selected Human Anti-CKAP5 "Blunt/Fray" DsiRNAs

5'-UAGCCAAGAAACCUGGAUGGAAAGA$_C$$^{C-3'}_C$ (SEQ ID NO: 3384)

3'-AUCGGUUCUUUGGACCUACCUUUCU$_U$$_{A-5'}$ (SEQ ID NO: 1080)

CKAP5-2083 Target: 5'-TAGCCAAGAAACCTGGATGGAAAGAAA-3' (SEQ ID NO: 1656)

5'-AAGAAACCUGGAUGGAAAGAAACUA$_C$$^{C-3'}_C$ (SEQ ID NO: 3385)

3'-UUCUUUGGACCUACCUUUCUUUGAU$_U$$_{A-5'}$ (SEQ ID NO: 1081)

CKAP5-2088 Target: 5'-AAGAAACCTGGATGGAAAGAAACTAAT-3' (SEQ ID NO: 1657)

5'-AGGUGAUGCAAAUGAAGCUUCAUAU$_C$$^{A-3'}_C$ (SEQ ID NO: 3386)

3'-UCCACUACGUUUACUUCGAAGUAUA$_U$$_{C-5'}$ (SEQ ID NO: 1082)

CKAP5-2119 Target: 5'-AGGTGATGCAAATGAAGCTTCATATAG-3' (SEQ ID NO: 1658)

5'-CAAAACGUCAGCUCAGGUUGUAUUA$_A$$^{C-3'}$ (SEQ ID NO: 3387)

3'-GUUUUGCAGUCGAGUCCAACAUAAU$_C$$_{A-5'}$ (SEQ ID NO: 1083)

CKAP5-2177 Target: 5'-CAAAACGTCAGCTCAGGTTGTATTAGA-3' (SEQ ID NO: 1659)

5'-UGCAAAAGAAGCUAUGACAGCAAUA$_A$$^{A-3'}$ (SEQ ID NO: 3388)

3'-ACGUUUUCUUCGAUACUGUCGUUAU$_C$$_{G-5'}$ (SEQ ID NO: 1084)

CKAP5-2246 Target: 5'-TGCAAAAGAAGCTATGACAGCAATAGC-3' (SEQ ID NO: 1660)

5'-GACAGCAAUAGCCGAAGCCUGUAUG$_C$$^{C-3'}_C$ (SEQ ID NO: 3389)

3'-CUGUCGUUAUCGGCUUCGGACAUAC$_A$$_{A-5'}$ (SEQ ID NO: 1085)

CKAP5-2261 Target: 5'-GACAGCAATAGCCGAAGCCTGTATGTT-3' (SEQ ID NO: 1661)

5'-CCGAAGCCUGUAUGUUACCAUGGAC$_C$$^{A-3'}$ (SEQ ID NO: 3390)

3'-GGCUUCGGACAUACAAUGGUACCUG$_A$$_{C-5'}$ (SEQ ID NO: 1086)

CKAP5-2272 Target: 5'-CCGAAGCCTGTATGTTACCATGGACTG-3' (SEQ ID NO: 1662)

5'-CAAAAAUCAGUCAGAAACUCUGAAU$_C$$^{A-3'}$ (SEQ ID NO: 3391)

3'-GUUUUUAGUCAGUCUUUGAGACUUA$_A$$_{C-5'}$ (SEQ ID NO: 1087)

CKAP5-2339 Target: 5'-CAAAAATCAGTCAGAAACTCTGAATTG-3' (SEQ ID NO: 1663)

TABLE 5-continued

Selected Human Anti-CKAP5 "Blunt/Fray" DsiRNAs

5'-AAAGCUUUCAUUAGCAAUGUGAAGA$_A{}^{C-3'}$ (SEQ ID NO: 3392)

3'-UUUCGAAAGUAAUCGUUACACUUCU$_G{}_{A-5'}$ (SEQ ID NO: 1088)

CKAP5-2412 Target: 5'-AAAGCTTTCATTAGCAATGTGAAGACA-3' (SEQ ID NO: 1664)

5'-UUGAGAAGAUGCAGGGACAAAGUCC$_C{}^{A-3'}$ (SEQ ID NO: 3393)

3'-AACUCUUCUACGUCCCUGUUUCAGG$_U{}_{G-5'}$ (SEQ ID NO: 1089)

CKAP5-2578 Target: 5'-TTGAGAAGATGCAGGGACAAAGTCCAC-3' (SEQ ID NO: 1665)

5'-GAGCAAUGAUGUCGUUGAUCUUUG$_A{}^{A-3'}$ (SEQ ID NO: 3394)

3'-CUCGUUACUACAGCAACUAGAAAAC$_G{}_{G-5'}$ (SEQ ID NO: 1090)

CKAP5-2684 Target: 5'-GAGCAATGATGTCGTTGATCTTTTGCC-3' (SEQ ID NO: 1666)

5'-AUGAAGUGGCAGGUAUUAUUAAUGA$_A{}^{A-3'}$ (SEQ ID NO: 3395)

3'-UACUUCACCGUUCAUAAUAAUUACU$_G{}_{C-5'}$ (SEQ ID NO: 1091)

CKAP5-2797 Target: 5'-ATGAAGTGGCAGGTATTATTAATGACG-3' (SEQ ID NO: 1667)

5'-CUGCCUUGAAGGGUCGACUCAAUGA$_C{}^{C-3'}$ (SEQ ID NO: 3396)

3'-GACGGAACUUCCCAGCUGAGUUACU$_A{}_{A-5'}$ (SEQ ID NO: 1092)

CKAP5-2860 Target: 5'-CTGCCTTGAAGGGTCGACTCAATGATT-3' (SEQ ID NO: 1668)

5'-UUGAAGGGUCGACUCAAUGAUUCAA$_C{}^{C-3'}$ (SEQ ID NO: 3397)

3'-AACUUCCCAGCUGAGUUACUAAGUU$_U{}_{A-5'}$ (SEQ ID NO: 1093)

CKAP5-2865 Target: 5'-TTGAAGGGTCGACTCAATGATTCAAAT-3' (SEQ ID NO: 1669)

5'-UCGACUCAAUGAUUCAAAUAAAAUC$_C{}^{C-3'}$ (SEQ ID NO: 3398)

3'-AGCUGAGUUACUAAGUUUAUUUUAG$_A{}_{A-5'}$ (SEQ ID NO: 1094)

CKAP5-2873 Target: 5'-TCGACTCAATGATTCAAATAAAATCTT-3' (SEQ ID NO: 1670)

5'-CAAUGAUUCAAAUAAAAUCUUGGUA$_A{}^{C-3'}$ (SEQ ID NO: 3399)

3'-GUUACUAAGUUUAUUUUAGAACCAU$_G{}_{A-5'}$ (SEQ ID NO: 1095)

CKAP5-2879 Target: 5'-CAATGATTCAAATAAAATCTTGGTACA-3' (SEQ ID NO: 1671)

TABLE 5-continued

Selected Human Anti-CKAP5 "Blunt/Fray" DsiRNAs

5'-GUAGCCAUGGGCCCAAAUAUUAAGC$_C$$^{C-3'}$  (SEQ ID NO: 3400)

3'-CAUCGGUACCCGGGUUUAUAAUUCG$_U$$_{A-5'}$  (SEQ ID NO: 1096)

CKAP5-2937 Target: 5'-GTAGCCATGGGCCCAAATATTAAGCAA-3'  (SEQ ID NO: 1672)

5'-CCAAAUAUUAAGCAACAUGUAAAAA$_C$$^{C-3'}$  (SEQ ID NO: 3401)

3'-GGUUUAUAAUUCGUUGUACAUUUUU$_U$$_{A-5'}$  (SEQ ID NO: 1097)

CKAP5-2949 Target: 5'-CCAAATATTAAGCAACATGTAAAAAAT-3'  (SEQ ID NO: 1673)

5'-GUCCUUGGAGACAGCAAGAACAAUG$_C$$^{C-3'}$  (SEQ ID NO: 3402)

3'-CAGGAACCUCUGUCGUUCUUGUUAC$_A$$_{A-5'}$  (SEQ ID NO: 1098)

CKAP5-2997 Target: 5'-GTCCTTGGAGACAGCAAGAACAATGTT-3'  (SEQ ID NO: 1674)

5'-UGGAGACAGCAAGAACAAUGUUCGA$_A$$^{A-3'}$  (SEQ ID NO: 3403)

3'-ACCUCUGUCGUUCUUGUUACAAGCU$_C$$_{G-5'}$  (SEQ ID NO: 1099)

CKAP5-3002 Target: 5'-TGGAGACAGCAAGAACAATGTTCGAGC-3'  (SEQ ID NO: 1675)

5'-UUCAUGAUGCAUUUAGGAUAUGAAA$_C$$^{C-3'}$  (SEQ ID NO: 3404)

3'-AAGUACUACGUAAAUCCUAUACUUU$_U$$_{A-5'}$  (SEQ ID NO: 1100)

CKAP5-3285 Target: 5'-TTCATGATGCATTTAGGATATGAAAAA-3'  (SEQ ID NO: 1676)

5'-UGCUAGAGAAAGCCAAAGUUAACAU$_A$$^{A-3'}$  (SEQ ID NO: 3405)

3'-ACGAUCUCUUUCGGUUUCAAUUGUA$_C$$_{G-5'}$  (SEQ ID NO: 1101)

CKAP5-3367 Target: 5'-TGCTAGAGAAAGCCAAAGTTAACATGC-3'  (SEQ ID NO: 1677)

5'-AAGGGAAGAAGAUGCCAAGCAAAAC$_A$$^{C-3'}$  (SEQ ID NO: 3406)

3'-UUCCCUUCUUCUACGGUUCGUUUUG$_G$$_{A-5'}$  (SEQ ID NO: 1102)

CKAP5-3571 Target: 5'-AAGGGAAGAAGATGCCAAGCAAAACCA-3'  (SEQ ID NO: 1678)

5'-UGGAAAAGAGCAAGGAUGAAAGAU$_A$$^{C-3'}$  (SEQ ID NO: 3407)

3'-ACCUUUUCUCGUUUCCUACUUUCUA$_C$$_{A-5'}$  (SEQ ID NO: 1103)

CKAP5-3650 Target: 5'-TGGAAAAGAGCAAAGGATGAAAGATGA-3'  (SEQ ID NO: 1679)

TABLE 5-continued

Selected Human Anti-CKAP5 "Blunt/Fray" DsiRNAs

5'-AAGAGCAAGGAUGAAAGAUGAAAA$_C{}^{C-3'}_{C}$ (SEQ ID NO: 3408)

3'-UUCUCGUUUCCUACUUUCUACUUUU$_U{}_{C-5'}$ (SEQ ID NO: 1104)

CKAP5-3655 Target: 5'-AAGAGCAAAGGATGAAAGATGAAAAAG-3' (SEQ ID NO: 1680)

5'-ACGGGAUGAAUACAUUGAGCAACUA$_C{}^{C-3'}$ (SEQ ID NO: 3409)

3'-UGCCCUACUUAUGUAACUCGUUGAU$_U{}_{A-5'}$ (SEQ ID NO: 1105)

CKAP5-3716 Target: 5'-ACGGGATGAATACATTGAGCAACTAAA-3' (SEQ ID NO: 1681)

5'-AUGAAUACAUUGAGCAACUAAAGAC$_C{}^{A-3'}$ (SEQ ID NO: 3410)

3'-UACUUAUGUAACUCGUUGAUUUCUG$_A{}_{G-5'}$ (SEQ ID NO: 1106)

CKAP5-3721 Target: 5'-ATGAATACATTGAGCAACTAAAGACTC-3' (SEQ ID NO: 1682)

5'-AAAGUGGCUUACCCUGAGGUUUUUU$_A{}^{C-3'}$ (SEQ ID NO: 3411)

3'-UUUCACCGAAUGGGACUCCAAAAAA$_C{}_{A-5'}$ (SEQ ID NO: 1107)

CKAP5-3890 Target: 5'-AAAGTGGCTTACCCTGAGGTTTTTGA-3' (SEQ ID NO: 1683)

5'-ACCCUGAGGUUUUUUGACACCAAUA$_A{}^{C-3'}$ (SEQ ID NO: 3412)

3'-UGGGACUCCAAAAAACUGUGGUUAU$_G{}_{A-5'}$ (SEQ ID NO: 1108)

CKAP5-3900 Target: 5'-ACCCTGAGGTTTTTGACACCAATACA-3' (SEQ ID NO: 1684)

5'-ACCAAUACAAGCGUCCUGAUGAAAG$_A{}^{C-3'}$ (SEQ ID NO: 3413)

3'-UGGUUAUGUUCGCAGGACUACUUUC$_G{}_{A-5'}$ (SEQ ID NO: 1109)

CKAP5-3918 Target: 5'-ACCAATACAAGCGTCCTGATGAAAGCA-3' (SEQ ID NO: 1685)

5'-GCGUCCUGAUGAAAGCACUAGAAUA$_C{}^{C-3'}$ (SEQ ID NO: 3414)

3'-CGCAGGACUACUUUCGUGAUCUUAU$_A{}_{A-5'}$ (SEQ ID NO: 1110)

CKAP5-3928 Target: 5'-GCGTCCTGATGAAAGCACTAGAATATT-3' (SEQ ID NO: 1686)

5'-UGAUGAAAGCACUAGAAUAUUUAAA$_C{}^{C-3'}$ (SEQ ID NO: 3415)

3'-ACUACUUUCGUGAUCUUAUAAAUUU$_U{}_{A-5'}$ (SEQ ID NO: 1111)

CKAP5-3934 Target: 5'-TGATGAAAGCACTAGAATATTTAAAT-3' (SEQ ID NO: 1687)

TABLE 5-continued

Selected Human Anti-CKAP5 "Blunt/Fray" DsiRNAs

5'-UGGAAAUCUUUCUGAAAAGGAUAUG$_C{}^{A-3'}$ (SEQ ID NO: 3416)

3'-ACCUUUAGAAAGACUUUUCCUAUAC$_U{}_{C-5'}$ (SEQ ID NO: 1112)

CKAP5-4367 Target: 5'-TGGAAATCTTTCTGAAAAGGATATGAG-3' (SEQ ID NO: 1688)

5'-CUGAAAAGGAUAUGAGCAUGCUCGA$_A{}^{A-3'}$ (SEQ ID NO: 3417)

3'-GACUUUUCCUAUACUCGUACGAGCU$_C{}_{C-5'}$ (SEQ ID NO: 1113)

CKAP5-4378 Target: 5'-CTGAAAAGGATATGAGCATGCTCGAGG-3' (SEQ ID NO: 1689)

5'-AAGCUCCAAUGCCAACAUGUUACGC$_C{}^{C-3'}$ (SEQ ID NO: 3418)

3'-UUCGAGGUUACGGUUGUACAAUGCG$_U{}_{A-5'}$ (SEQ ID NO: 1114)

CKAP5-4487 Target: 5'-AAGCTCCAATGCCAACATGTTACGCAA-3' (SEQ ID NO: 1690)

5'-CCAAUGCCAACAUGUUACGCAAGGG$_C{}^{A-3'}$ (SEQ ID NO: 3419)

3'-GGUUACGGUUGUACAAUGCGUUCCC$_U{}_{G-5'}$ (SEQ ID NO: 1115)

CKAP5-4492 Target: 5'-CCAATGCCAACATGTTACGCAAGGGAC-3' (SEQ ID NO: 1691)

5'-AUGUGAAAUGCCAGAACUUGUUCAG$_A{}^{C-3'}$ (SEQ ID NO: 3420)

3'-UACACUUUACGGUCUUGAACAAGUC$_G{}_{A-5'}$ (SEQ ID NO: 1116)

CKAP5-4649 Target: 5'-ATGTGAAATGCCAGAACTTGTTCAGCA-3' (SEQ ID NO: 1692)

5'-GCCAGAACUUGUUCAGCACAAACUG$_A{}^{C-3'}$ (SEQ ID NO: 3421)

3'-CGGUCUUGAACAAGUCGUGUUUGAC$_C{}_{A-5'}$ (SEQ ID NO: 1117)

CKAP5-4658 Target: 5'-GCCAGAACTTGTTCAGCACAAACTGGA-3' (SEQ ID NO: 1693)

5'-GCACAAACUGGAUGACAUUUUUGAG$_A{}^{A-3'}$ (SEQ ID NO: 3422)

3'-CGUGUUUGACCUACUGUAAAAACUC$_G{}_{G-5'}$ (SEQ ID NO: 1118)

CKAP5-4673 Target: 5'-GCACAAACTGGATGACATTTTTGAGCC-3' (SEQ ID NO: 1694)

5'-UGGAUGACAUUUUUGAGCCAGUCCU$_C{}^{C-3'}$ (SEQ ID NO: 3423)

3'-ACCUACUGUAAAAACUCGGUCAGGA$_A{}_{A-5'}$ (SEQ ID NO: 1119)

CKAP5-4681 Target: 5'-TGGATGACATTTTTGAGCCAGTCCTTA-3' (SEQ ID NO: 1695)

TABLE 5-continued

Selected Human Anti-CKAP5 "Blunt/Fray" DsiRNAs

5'-GACAUUUUUGAGCCAGUCCUUAUUC$_A{}^{C-3'}$ (SEQ ID NO: 3424)

3'-CUGUAAAACUCGGUCAGGAAUAAG$_G{}_{A-5'}$ (SEQ ID NO: 1120)

CKAP5-4686 Target: 5'-GACATTTTTGAGCCAGTCCTTATTCCT-3' (SEQ ID NO: 1696)

5'-UUGAGCCAGUCCUUAUUCCUGAACC$_A{}^{C-3'}$ (SEQ ID NO: 3425)

3'-AACUCGGUCAGGAAUAAGGACUUGG$_G{}_{A-5'}$ (SEQ ID NO: 1121)

CKAP5-4693 Target: 5'-TTGAGCCAGTCCTTATTCCTGAACCCA-3' (SEQ ID NO: 1697)

5'-CACUGGAGUACUAAAAGACCUAAUG$_A{}^{C-3'}$ (SEQ ID NO: 3426)

3'-GUGACCUCAUGAUUUUCUGGAUUAC$_G{}_{A-5'}$ (SEQ ID NO: 1122)

CKAP5-5057 Target: 5'-CACTGGAGTACTAAAAGACCTAATGCA-3' (SEQ ID NO: 1698)

5'-UGGUGAAGGUUCUGGAGAAGUCAGA$_A{}^{A-3'}$ (SEQ ID NO: 3427)

3'-ACCACUUCCAAGACCUCUUCAGUCU$_G{}_{G-5'}$ (SEQ ID NO: 1123)

CKAP5-5167 Target: 5'-TGGTGAAGGTTCTGGAGAAGTCAGACC-3' (SEQ ID NO: 1699)

5'-AUCCUGAGUGCCCUACUUGUUUUGC$_C{}^{A-3'}$ (SEQ ID NO: 3428)

3'-UAGGACUCACGGGAUGAACAAAACG$_A{}_{G-5'}$ (SEQ ID NO: 1124)

CKAP5-5202 Target: 5'-ATCCTGAGTGCCCTACTTGTTTTGCTC-3' (SEQ ID NO: 1700)

5'-AACAGCCAGUUCUCCCAAAUUCUCA$_A{}^{C-3'}$ (SEQ ID NO: 3429)

3'-UUGUCGGUCAAGAGGGUUUAAGAGU$_C{}_{A-5'}$ (SEQ ID NO: 1125)

CKAP5-5246 Target: 5'-AACAGCCAGTTCTCCCAAATTCTCAGA-3' (SEQ ID NO: 1701)

5'-GAGCUUGUUAUGAAGUGUCUCUGGA$_A{}^{C-3'}$ (SEQ ID NO: 3430)

3'-CUCGAACAAUACUUCACAGAGACCU$_C{}_{A-5'}$ (SEQ ID NO: 1126)

CKAP5-5271 Target: 5'-GAGCTTGTTATGAAGTGTCTCTGGAGA-3' (SEQ ID NO: 1702)

5'-UUCGACUGUUGCCUGAUACCAUCAA$_C{}^{C-3'}$ (SEQ ID NO: 3431)

3'-AAGCUGACAACGGACUAUGGUAGUU$_A{}_{A-5'}$ (SEQ ID NO: 1127)

CKAP5-5302 Target: 5'-TTCGACTGTTGCCTGATACCATCAATA-3' (SEQ ID NO: 1703)

TABLE 5-continued

Selected Human Anti-CKAP5 "Blunt/Fray" DsiRNAs

5'-CUGUUGCCUGAUACCAUCAAUAGCA$_C$$^{C-3'}$ (SEQ ID NO: 3432)

3'-GACAACGGACUAUGGUAGUUAUCGU$_{A-5'}^A$ (SEQ ID NO: 1128)

CKAP5-5307 Target: 5'-CTGTTGCCTGATACCATCAATAGCATT-3' (SEQ ID NO: 1704)

5'-GCCUGAUACCAUCAAUAGCAUUAAC$_A$$^{C-3'}$ (SEQ ID NO: 3433)

3'-CGGACUAUGGUAGUUAUCGUAAUUG$_{A-5'}^G$ (SEQ ID NO: 1129)

CKAP5-5312 Target: 5'-GCCTGATACCATCAATAGCATTAACCT-3' (SEQ ID NO: 1705)

5'-CCAUCAAUAGCAUUAACCUAGACAG$_C$$^{C-3'}$ (SEQ ID NO: 3434)

3'-GGUAGUUAUCGUAAUUGGAUCUGUC$_{A-5'}^U$ (SEQ ID NO: 1130)

CKAP5-5320 Target: 5'-CCATCAATAGCATTAACCTAGACAGAA-3' (SEQ ID NO: 1706)

5'-AAUAGCAUUAACCUAGACAGAAUUC$_C$$^{C-3'}$ (SEQ ID NO: 3435)

3'-UUAUCGUAAUUGGAUCUGUCUUAAG$_{A-5'}^A$ (SEQ ID NO: 1131)

CKAP5-5325 Target: 5'-AATAGCATTAACCTAGACAGAATTCTT-3' (SEQ ID NO: 1707)

5'-CAGAAUUCUUCUGGAUAUCCACAUU$_C$$^{C-3'}$ (SEQ ID NO: 3436)

3'-GUCUUAAGAAGACCUAUAGGUGUAA$_{A-5'}^A$ (SEQ ID NO: 1132)

CKAP5-5342 Target: 5'-CAGAATTCTTCTGGATATCCACATTTT-3' (SEQ ID NO: 1708)

5'-UUCUGGAUAUCCACAUUUUCAUGAA$_A$$^{A-3'}$ (SEQ ID NO: 3437)

3'-AAGACCUAUAGGUGUAAAAGUACUU$_{C-5'}^C$ (SEQ ID NO: 1133)

CKAP5-5350 Target: 5'-TTCTGGATATCCACATTTTCATGAAGG-3' (SEQ ID NO: 1709)

5'-CCAAAGAGAAACUGAAGCAAUGCAA$_C$$^{C-3'}$ (SEQ ID NO: 3438)

3'-GGUUUCUCUUUGACUUCGUUACGUU$_{A-5'}^U$ (SEQ ID NO: 1134)

CKAP5-5383 Target: 5'-CCAAAGAGAAACTGAAGCAATGCAAAA-3' (SEQ ID NO: 1710)

5'-GAGAAACUGAAGCAAUGCAAAAGUG$_C$$^{C-3'}$ (SEQ ID NO: 3439)

3'-CUCUUUGACUUCGUUACGUUUUCAC$_{A-5'}^U$ (SEQ ID NO: 1135)

CKAP5-5388 Target: 5'-GAGAAACTGAAGCAATGCAAAAGTGAA-3' (SEQ ID NO: 1711)

TABLE 5-continued

Selected Human Anti-CKAP5 "Blunt/Fray" DsiRNAs

5'-GCCGGAUGAUGAAGCACAGUAUGGA$_A$$^{AA-3'}$ (SEQ ID NO: 3440)

3'-CGGCCUACUACUUCGUGUCAUACCU$_{G-5'}^{G}$ (SEQ ID NO: 1136)

CKAP5-5536 Target: 5'-GCCGGATGATGAAGCACAGTATGGACC-3' (SEQ ID NO: 1712)

5'-AACAGAAAAGGGAGCAUCUCGAAUA$_A$$^{C-3'}$ (SEQ ID NO: 3441)

3'-UUGUCUUUUCCCUCGUAGAGCUUAU$_{A-5'}^{C}$ (SEQ ID NO: 1137)

CKAP5-5588 Target: 5'-AACAGAAAAGGGAGCATCTCGAATAGA-3' (SEQ ID NO: 1713)

5'-AAAGGGAGCAUCUCGAAUAGAUGAA$_C$$^{C-3'}$ (SEQ ID NO: 3442)

3'-UUUCCCUCGUAGAGCUUAUCUACUU$_{A-5'}^{U}$ (SEQ ID NO: 1138)

CKAP5-5594 Target: 5'-AAAGGGAGCATCTCGAATAGATGAAAA-3' (SEQ ID NO: 1714)

5'-GAGCAUCUCGAAUAGAUGAAAAAUC$_C$$^{C-3'}$ (SEQ ID NO: 3443)

3'-CUCGUAGAGCUUAUCUACUUUUUAG$_{A-5'}^{U}$ (SEQ ID NO: 1139)

CKAP5-5599 Target: 5'-GAGCATCTCGAATAGATGAAAAATCAT-3' (SEQ ID NO: 1715)

5'-AAGAGGGACUAGCAGAGUUAUAUGA$_C$$^{C-3'}$ (SEQ ID NO: 3444)

3'-UUCUCCCUGAUCGUCUCAAUAUACU$_{A-5'}^{U}$ (SEQ ID NO: 1140)

CKAP5-5692 Target: 5'-AAGAGGGACTAGCAGAGTTATATGAAT-3' (SEQ ID NO: 1716)

5'-AUACUCAGAUGCUGACAUUGAACCA$_C$$^{C-3'}$ (SEQ ID NO: 3445)

3'-UAUGAGUCUACGACUGUAACUUGGU$_{A-5'}^{A}$ (SEQ ID NO: 1141)

CKAP5-5729 Target: 5'-ATACTCAGATGCTGACATTGAACCATT-3' (SEQ ID NO: 1717)

5'-AGCAUUCAGACCUGGAUUCUAACCA$_A$$^{C-3'}$ (SEQ ID NO: 3446)

3'-UCGUAAGUCUGGACCUAAGAUUGGU$_{A-5'}^{C}$ (SEQ ID NO: 1142)

CKAP5-6130 Target: 5'-AGCATTCAGACCTGGATTCTAACCAGA-3' (SEQ ID NO: 1718)

5'-CAGACCUGGAUUCUAACCAGACUCA$_A$$^{C-3'}$ (SEQ ID NO: 3447)

3'-GUCUGGACCUAAGAUUGGUCUGAGU$_{A-5'}^{G}$ (SEQ ID NO: 1143)

CKAP5-6136 Target: 5'-CAGACCTGGATTCTAACCAGACTCACT-3' (SEQ ID NO: 1719)

TABLE 5-continued

Selected Human Anti-CKAP5 "Blunt/Fray" DsiRNAs

5'-CUGGAUUCUAACCAGACUCACUCUU$_A{}^{AC-3'}$ (SEQ ID NO: 3448)

3'-GACCUAAGAUUGGUCUGAGUGAGAA$_G{}_{A-5'}$ (SEQ ID NO: 1144)

CKAP5-6141 Target: 5'-CTGGATTCTAACCAGACTCACTCTTCA-3' (SEQ ID NO: 1720)

5'-CAGCUAACAUAGACGACUUGAAAAA$_C{}^{CC-3'}$ (SEQ ID NO: 3449)

3'-GUCGAUUGUAUCUGCUGAACUUUUU$_U{}_{A-5'}$ (SEQ ID NO: 1145)

CKAP5-6193 Target: 5'-CAGCTAACATAGACGACTTGAAAAAAA-3' (SEQ ID NO: 1721)

5'-AACAUAGACGACUUGAAAAAAAGAC$_C{}^{A-3'}$ (SEQ ID NO: 3450)

3'-UUGUAUCUGCUGAACUUUUUUUCUG$_A{}_{C-5'}$ (SEQ ID NO: 1146)

CKAP5-6198 Target: 5'-AACATAGACGACTTGAAAAAAAGACTG-3' (SEQ ID NO: 1722)

5'-AACUAGAAGUCCUCAUAGUUUAAAA$_C{}^{A-3'}$ (SEQ ID NO: 3451)

3'-UUGAUCUUCAGGAGUAUCAAAUUUU$_A{}_{C-5'}$ (SEQ ID NO: 1147)

CKAP5-6294 Target: 5'-AACTAGAAGTCCTCATAGTTTAAAATG-3' (SEQ ID NO: 1723)

5'-UGGAUGAGUUUAGUGUACAGACUUG$_C{}^{C-3'}$ (SEQ ID NO: 3452)

3'-ACCUACUCAAAUCACAUGUCUGAAC$_A{}_{A-5'}$ (SEQ ID NO: 1148)

CKAP5-6459 Target: 5'-TGGATGAGTTTAGTGTACAGACTTGTA-3' (SEQ ID NO: 1724)

5'-CCCAGAUCCUUUUCUUUUCUUUUUA$_C{}^{C-3'}$ (SEQ ID NO: 3453)

3'-GGGUCUAGGAAAAGAAAAGAAAAAU$_U{}_{A-5'}$ (SEQ ID NO: 1149)

CKAP5-6517 Target: 5'-CCCAGATCCTTTTCTTTTCTTTTTAAT-3' (SEQ ID NO: 1725)

5'-AUUGCUCAUUUGUAAAAUUGUCCUA$_C{}^{C-3'}$ (SEQ ID NO: 3454)

3'-UAACGAGUAAACAUUUUAACAGGAU$_U{}_{A-5'}$ (SEQ ID NO: 1150)

CKAP5-6542 Target: 5'-ATTGCTCATTTGTAAAATTGTCCTAAT-3' (SEQ ID NO: 1726)

5'-CUGAAGGGUCACUGUAUUCUGUAUG$_C{}^{C-3'}$ (SEQ ID NO: 3455)

3'-GACUUCCCAGUGACAUAAGACAUAC$_U{}_{A-5'}$ (SEQ ID NO: 1151)

CKAP5-6648 Target: 5'-CTGAAGGGTCACTGTATTCTGTATGAA-3' (SEQ ID NO: 1727)

TABLE 5-continued

Selected Human Anti-CKAP5 "Blunt/Fray" DsiRNAs

```
                    C C-3'
5'-GGGUCACUGUAUUCUGUAUGAAUGC C      (SEQ ID NO: 3456)

3'-CCCAGUGACAUAAGACAUACUUACG U      (SEQ ID NO: 1152)
                             A-5'
```

CKAP5-6653 Target: 5'-GGGTCACTGTATTCTGTATGAATGCAT-3' (SEQ ID NO: 1728)

TABLE 6

Selected Human Anti-CKAP5 "Blunt/Blunt" DsiRNAs

|  |  |  |
|---|---|---|
| | 5'-UGGAAGCACAAUGGGAGAUGACAGUGA-3' | (SEQ ID NO: 3457) |
| | 3'-ACCUUCGUGUUACCCUCUACUGUCACU-5' | (SEQ ID NO: 577) |
| CKAP5-143 Target: | 5'-TGGAAGCACAATGGGAGATGACAGTGA-3' | (SEQ ID NO: 1153) |
| | 5'-GAAGCACAAUGGGAGAUGACAGUGAGU-3' | (SEQ ID NO: 3458) |
| | 3'-CUUCGUGUUACCCUCUACUGUCACUCA-5' | (SEQ ID NO: 578) |
| CKAP5-145 Target: | 5'-GAAGCACAATGGGAGATGACAGTGAGT-3' | (SEQ ID NO: 1154) |
| | 5'-AGCACAAUGGGAGAUGACAGUGAGUGG-3' | (SEQ ID NO: 3459) |
| | 3'-UCGUGUUACCCUCUACUGUCACUCACC-5' | (SEQ ID NO: 579) |
| CKAP5-147 Target: | 5'-AGCACAATGGGAGATGACAGTGAGTGG-3' | (SEQ ID NO: 1155) |
| | 5'-CACAAUGGGAGAUGACAGUGAGUGGUU-3' | (SEQ ID NO: 3460) |
| | 3'-GUGUUACCCUCUACUGUCACUCACCAA-5' | (SEQ ID NO: 580) |
| CKAP5-149 Target: | 5'-CACAATGGGAGATGACAGTGAGTGGTT-3' | (SEQ ID NO: 1156) |
| | 5'-CAAUGGGAGAUGACAGUGAGUGGUUGA-3' | (SEQ ID NO: 3461) |
| | 3'-GUUACCCUCUACUGUCACUCACCAACU-5' | (SEQ ID NO: 581) |
| CKAP5-151 Target: | 5'-CAATGGGAGATGACAGTGAGTGGTTGA-3' | (SEQ ID NO: 1157) |
| | 5'-AUGGGAGAUGACAGUGAGUGGUUGAAA-3' | (SEQ ID NO: 3462) |
| | 3'-UACCCUCUACUGUCACUCACCAACUUU-5' | (SEQ ID NO: 582) |
| CKAP5-153 Target: | 5'-ATGGGAGATGACAGTGAGTGGTTGAAA-3' | (SEQ ID NO: 1158) |
| | 5'-GGGAGAUGACAGUGAGUGGUUGAAACU-3' | (SEQ ID NO: 3463) |
| | 3'-CCCUCUACUGUCACUCACCAACUUUGA-5' | (SEQ ID NO: 583) |
| CKAP5-155 Target: | 5'-GGGAGATGACAGTGAGTGGTTGAAACT-3' | (SEQ ID NO: 1159) |
| | 5'-GAGAUGACAGUGAGUGGUUGAAACUGC-3' | (SEQ ID NO: 3464) |
| | 3'-CUCUACUGUCACUCACCAACUUUGACG-5' | (SEQ ID NO: 584) |
| CKAP5-157 Target: | 5'-GAGATGACAGTGAGTGGTTGAAACTGC-3' | (SEQ ID NO: 1160) |
| | 5'-GAUGACAGUGAGUGGUUGAAACUGCCA-3' | (SEQ ID NO: 3465) |
| | 3'-CUACUGUCACUCACCAACUUUGACGGU-5' | (SEQ ID NO: 585) |
| CKAP5-159 Target: | 5'-GATGACAGTGAGTGGTTGAAACTGCCA-3' | (SEQ ID NO: 1161) |
| | 5'-CUGAAGAUCUUCCAGAAAAUAAAGGAU-3' | (SEQ ID NO: 3466) |
| | 3'-GACUUCUAGAAGGUCUUUUAUUUCCUA-5' | (SEQ ID NO: 586) |
| CKAP5-246 Target: | 5'-CTGAAGATCTTCCAGAAAATAAAGGAT-3' | (SEQ ID NO: 1162) |
| | 5'-GAAGAUCUUCCAGAAAAUAAAGGAUGA-3' | (SEQ ID NO: 3467) |
| | 3'-CUUCUAGAAGGUCUUUUAUUUCCUACU-5' | (SEQ ID NO: 587) |
| CKAP5-248 Target: | 5'-GAAGATCTTCCAGAAAATAAAGGATGA-3' | (SEQ ID NO: 1163) |
| | 5'-AGAUCUUCCAGAAAAUAAAGGAUGAAA-3' | (SEQ ID NO: 3468) |
| | 3'-UCUAGAAGGUCUUUUAUUUCCUACUUU-5' | (SEQ ID NO: 588) |
| CKAP5-250 Target: | 5'-AGATCTTCCAGAAAATAAAGGATGAAA-3' | (SEQ ID NO: 1164) |
| | 5'-AUCUUCCAGAAAAUAAAGGAUGAAAAG-3' | (SEQ ID NO: 3469) |
| | 3'-UAGAAGGUCUUUUAUUUCCUACUUUUC-5' | (SEQ ID NO: 589) |
| CKAP5-252 Target: | 5'-ATCTTCCAGAAAATAAAGGATGAAAAG-3' | (SEQ ID NO: 1165) |
| | 5'-CUUCCAGAAAAUAAAGGAUGAAAAGAG-3' | (SEQ ID NO: 3470) |
| | 3'-GAAGGUCUUUUAUUUCCUACUUUUCUC-5' | (SEQ ID NO: 590) |
| CKAP5-254 Target: | 5'-CTTCCAGAAAATAAAGGATGAAAAGAG-3' | (SEQ ID NO: 1166) |
| | 5'-UCCAGAAAAUAAAGGAUGAAAAGAGCC-3' | (SEQ ID NO: 3471) |
| | 3'-AGGUCUUUUAUUUCCUACUUUUCUCGG-5' | (SEQ ID NO: 591) |
| CKAP5-256 Target: | 5'-TCCAGAAAATAAAGGATGAAAAGAGCC-3' | (SEQ ID NO: 1167) |

TABLE 6-continued

Selected Human Anti-CKAP5 "Blunt/Blunt" DsiRNAs

|  |  |  |
|---|---|---|
| | 5'-CAGAAAAUAAAGGAUGAAAAGAGCCCA-3' | (SEQ ID NO: 3472) |
| | 3'-GUCUUUUAUUUCCUACUUUUCUCGGGU-5' | (SEQ ID NO: 592) |
| CKAP5-258 Target: | 5'-CAGAAAATAAAGGATGAAAAGAGCCCA-3' | (SEQ ID NO: 1168) |
| | 5'-GAAAAUAAAGGAUGAAAAGAGCCCAGA-3' | (SEQ ID NO: 3473) |
| | 3'-CUUUUAUUUCCUACUUUUCUCGGGUCU-5' | (SEQ ID NO: 593) |
| CKAP5-260 Target: | 5'-GAAAATAAAGGATGAAAAGAGCCCAGA-3' | (SEQ ID NO: 1169) |
| | 5'-GAUCAAAAAAUUUGUCACUGAUUCCAA-3' | (SEQ ID NO: 3474) |
| | 3'-CUAGUUUUUUAAACAGUGACUAAGGUU-5' | (SEQ ID NO: 594) |
| CKAP5-308 Target: | 5'-GATCAAAAAATTTGTCACTGATTCCAA-3' | (SEQ ID NO: 1170) |
| | 5'-UCAAAAAAUUUGUCACUGAUUCCAAUG-3' | (SEQ ID NO: 3475) |
| | 3'-AGUUUUUUAAACAGUGACUAAGGUUAC-5' | (SEQ ID NO: 595) |
| CKAP5-310 Target: | 5'-TCAAAAAATTTGTCACTGATTCCAATG-3' | (SEQ ID NO: 1171) |
| | 5'-AAAAAAUUUGUCACUGAUUCCAAUGCA-3' | (SEQ ID NO: 3476) |
| | 3'-UUUUUUAAACAGUGACUAAGGUUACGU-5' | (SEQ ID NO: 596) |
| CKAP5-312 Target: | 5'-AAAAAATTTGTCACTGATTCCAATGCA-3' | (SEQ ID NO: 1172) |
| | 5'-AAAAUUUGUCACUGAUUCCAAUGCAGU-3' | (SEQ ID NO: 3477) |
| | 3'-UUUUAAACAGUGACUAAGGUUACGUCA-5' | (SEQ ID NO: 597) |
| CKAP5-314 Target: | 5'-AAAATTTGTCACTGATTCCAATGCAGT-3' | (SEQ ID NO: 1173) |
| | 5'-AAUUUGUCACUGAUUCCAAUGCAGUGG-3' | (SEQ ID NO: 3478) |
| | 3'-UUAAACAGUGACUAAGGUUACGUCACC-5' | (SEQ ID NO: 598) |
| CKAP5-316 Target: | 5'-AATTTGTCACTGATTCCAATGCAGTGG-3' | (SEQ ID NO: 1174) |
| | 5'-UUUGUCACUGAUUCCAAUGCAGUGGUU-3' | (SEQ ID NO: 3479) |
| | 3'-AAACAGUGACUAAGGUUACGUCACCAA-5' | (SEQ ID NO: 599) |
| CKAP5-318 Target: | 5'-TTTGTCACTGATTCCAATGCAGTGGTT-3' | (SEQ ID NO: 1175) |
| | 5'-UGUCACUGAUUCCAAUGCAGUGGUUCA-3' | (SEQ ID NO: 3480) |
| | 3'-ACAGUGACUAAGGUUACGUCACCAAGU-5' | (SEQ ID NO: 600) |
| CKAP5-320 Target: | 5'-TGTCACTGATTCCAATGCAGTGGTTCA-3' | (SEQ ID NO: 1176) |
| | 5'-UCACUGAUUCCAAUGCAGUGGUUCAAU-3' | (SEQ ID NO: 3481) |
| | 3'-AGUGACUAAGGUUACGUCACCAAGUUA-5' | (SEQ ID NO: 601) |
| CKAP5-322 Target: | 5'-TCACTGATTCCAATGCAGTGGTTCAAT-3' | (SEQ ID NO: 1177) |
| | 5'-ACUGAUUCCAAUGCAGUGGUUCAAUUG-3' | (SEQ ID NO: 3482) |
| | 3'-UGACUAAGGUUACGUCACCAAGUUAAC-5' | (SEQ ID NO: 602) |
| CKAP5-324 Target: | 5'-ACTGATTCCAATGCAGTGGTTCAATTG-3' | (SEQ ID NO: 1178) |
| | 5'-UGAUUCCAAUGCAGUGGUUCAAUUGAA-3' | (SEQ ID NO: 3483) |
| | 3'-ACUAAGGUUACGUCACCAAGUUAACUU-5' | (SEQ ID NO: 603) |
| CKAP5-326 Target: | 5'-TGATTCCAATGCAGTGGTTCAATTGAA-3' | (SEQ ID NO: 1179) |
| | 5'-AUUCCAAUGCAGUGGUUCAAUUGAAAG-3' | (SEQ ID NO: 3484) |
| | 3'-UAAGGUUACGUCACCAAGUUAACUUUC-5' | (SEQ ID NO: 604) |
| CKAP5-328 Target: | 5'-ATTCCAATGCAGTGGTTCAATTGAAAG-3' | (SEQ ID NO: 1180) |
| | 5'-UCCAAUGCAGUGGUUCAAUUGAAAGGA-3' | (SEQ ID NO: 3485) |
| | 3'-AGGUUACGUCACCAAGUUAACUUUCCU-5' | (SEQ ID NO: 605) |
| CKAP5-330 Target: | 5'-TCCAATGCAGTGGTTCAATTGAAAGGA-3' | (SEQ ID NO: 1181) |
| | 5'-CAAUGCAGUGGUUCAAUUGAAAGGAUU-3' | (SEQ ID NO: 3486) |
| | 3'-GUUACGUCACCAAGUUAACUUUCCUAA-5' | (SEQ ID NO: 606) |
| CKAP5-332 Target: | 5'-CAATGCAGTGGTTCAATTGAAAGGATT-3' | (SEQ ID NO: 1182) |
| | 5'-AUGCAGUGGUUCAAUUGAAAGGAUUAG-3' | (SEQ ID NO: 3487) |
| | 3'-UACGUCACCAAGUUAACUUUCCUAAUC-5' | (SEQ ID NO: 607) |
| CKAP5-334 Target: | 5'-ATGCAGTGGTTCAATTGAAAGGATTAG-3' | (SEQ ID NO: 1183) |
| | 5'-GCAGUGGUUCAAUUGAAAGGAUUAGAA-3' | (SEQ ID NO: 3488) |
| | 3'-CGUCACCAAGUUAACUUUCCUAAUCUU-5' | (SEQ ID NO: 608) |
| CKAP5-336 Target: | 5'-GCAGTGGTTCAATTGAAAGGATTAGAA-3' | (SEQ ID NO: 1184) |
| | 5'-CCAAGAUCAUAGUGGCCUGUAUAGAGA-3' | (SEQ ID NO: 3489) |
| | 3'-GGUUCUAGUAUCACCGGACAUAUCUCU-5' | (SEQ ID NO: 609) |
| CKAP5-565 Target: | 5'-CCAAGATCATAGTGGCCTGTATAGAGA-3' | (SEQ ID NO: 1185) |
| | 5'-AAGAUCAUAGUGGCCUGUAUAGAGACA-3' | (SEQ ID NO: 3490) |
| | 3'-UUCUAGUAUCACCGGACAUAUCUCUGU-5' | (SEQ ID NO: 610) |
| CKAP5-567 Target: | 5'-AAGATCATAGTGGCCTGTATAGAGACA-3' | (SEQ ID NO: 1186) |

TABLE 6-continued

Selected Human Anti-CKAP5 "Blunt/Blunt" DsiRNAs

```
                5'-GAUCAUAGUGGCCUGUAUAGAGACACU-3'  (SEQ ID NO: 3491)
                3'-CUAGUAUCACCGGACAUAUCUCUGUGA-5'  (SEQ ID NO: 611)
CKAP5-569 Target: 5'-GATCATAGTGGCCTGTATAGAGACACT-3' (SEQ ID NO: 1187)

5'-GACACUGAGGAAAGCCUUAAGUGAAUU-3'  (SEQ ID NO: 3492)
                3'-CUGUGACUCCUUUCGGAAUUCACUUAA-5'  (SEQ ID NO: 612)
CKAP5-590 Target: 5'-GACACTGAGGAAAGCCTTAAGTGAATT-3' (SEQ ID NO: 1188)

5'-CACUGAGGAAAGCCUUAAGUGAAUUUG-3'  (SEQ ID NO: 3493)
                3'-GUGACUCCUUUCGGAAUUCACUUAAAC-5'  (SEQ ID NO: 613)
CKAP5-592 Target: 5'-CACTGAGGAAAGCCTTAAGTGAATTTG-3' (SEQ ID NO: 1189)

5'-CUGAGGAAAGCCUUAAGUGAAUUUGGU-3'  (SEQ ID NO: 3494)
                3'-GACUCCUUUCGGAAUUCACUUAAACCA-5'  (SEQ ID NO: 614)
CKAP5-594 Target: 5'-CTGAGGAAAGCCTTAAGTGAATTTGGT-3' (SEQ ID NO: 1190)

5'-GAGGAAAGCCUUAAGUGAAUUUGGUUC-3'  (SEQ ID NO: 3495)
                3'-CUCCUUUCGGAAUUCACUUAAACCAAG-5'  (SEQ ID NO: 615)
CKAP5-596 Target: 5'-GAGGAAAGCCTTAAGTGAATTTGGTTC-3' (SEQ ID NO: 1191)

5'-GGAAAGCCUUAAGUGAAUUUGGUUCCA-3'  (SEQ ID NO: 3496)
                3'-CCUUUCGGAAUUCACUUAAACCAAGGU-5'  (SEQ ID NO: 616)
CKAP5-598 Target: 5'-GGAAAGCCTTAAGTGAATTTGGTTCCA-3' (SEQ ID NO: 1192)

5'-AAAGCCUUAAGUGAAUUUGGUUCCAAA-3'  (SEQ ID NO: 3497)
                3'-UUUCGGAAUUCACUUAAACCAAGGUUU-5'  (SEQ ID NO: 617)
CKAP5-600 Target: 5'-AAAGCCTTAAGTGAATTTGGTTCCAAA-3' (SEQ ID NO: 1193)

5'-AGCCUUAAGUGAAUUUGGUUCCAAAAU-3'  (SEQ ID NO: 3498)
                3'-UCGGAAUUCACUUAAACCAAGGUUUUA-5'  (SEQ ID NO: 618)
CKAP5-602 Target: 5'-AGCCTTAAGTGAATTTGGTTCCAAAAT-3' (SEQ ID NO: 1194)

5'-CCUUAAGUGAAUUUGGUUCCAAAAUCA-3'  (SEQ ID NO: 3499)
                3'-GGAAUUCACUUAAACCAAGGUUUUAGU-5'  (SEQ ID NO: 619)
CKAP5-604 Target: 5'-CCTTAAGTGAATTTGGTTCCAAAATCA-3' (SEQ ID NO: 1195)

5'-UUAAGUGAAUUUGGUUCCAAAAUCAUC-3'  (SEQ ID NO: 3500)
                3'-AAUUCACUUAAACCAAGGUUUUAGUAG-5'  (SEQ ID NO: 620)
CKAP5-606 Target: 5'-TTAAGTGAATTTGGTTCCAAAATCATC-3' (SEQ ID NO: 1196)

5'-AAGUGAAUUUGGUUCCAAAAUCAUCUU-3'  (SEQ ID NO: 3501)
                3'-UUCACUUAAACCAAGGUUUUAGUAGAA-5'  (SEQ ID NO: 621)
CKAP5-608 Target: 5'-AAGTGAATTTGGTTCCAAAATCATCTT-3' (SEQ ID NO: 1197)

5'-GUGAAUUUGGUUCCAAAAUCAUCUUGC-3'  (SEQ ID NO: 3502)
                3'-CACUUAAACCAAGGUUUUAGUAGAACG-5'  (SEQ ID NO: 622)
CKAP5-610 Target: 5'-GTGAATTTGGTTCCAAAATCATCTTGC-3' (SEQ ID NO: 1198)

5'-GAAUUUGGUUCCAAAAUCAUCUUGCUU-3'  (SEQ ID NO: 3503)
                3'-CUUAAACCAAGGUUUUAGUAGAACGAA-5'  (SEQ ID NO: 623)
CKAP5-612 Target: 5'-GAATTTGGTTCCAAAATCATCTTGCTT-3' (SEQ ID NO: 1199)

5'-UUCGUUCCCAACAAGAACUAGAAGCUA-3'  (SEQ ID NO: 3504)
                3'-AAGCAAGGGUUGUUCUUGAUCUUCGAU-5'  (SEQ ID NO: 624)
CKAP5-847 Target: 5'-TTCGTTCCCAACAAGAACTAGAAGCTA-3' (SEQ ID NO: 1200)

5'-CGUUCCCAACAAGAACUAGAAGCUAAA-3'  (SEQ ID NO: 3505)
                3'-GCAAGGGUUGUUCUUGAUCUUCGAUUU-5'  (SEQ ID NO: 625)
CKAP5-849 Target: 5'-CGTTCCCAACAAGAACTAGAAGCTAAA-3' (SEQ ID NO: 1201)

5'-UUCCCAACAAGAACUAGAAGCUAAAUU-3'  (SEQ ID NO: 3506)
                3'-AAGGGUUGUUCUUGAUCUUCGAUUUAA-5'  (SEQ ID NO: 626)
CKAP5-851 Target: 5'-TTCCCAACAAGAACTAGAAGCTAAATT-3' (SEQ ID NO: 1202)

5'-CCCAACAAGAACUAGAAGCUAAAUUGG-3'  (SEQ ID NO: 3507)
                3'-GGGUUGUUCUUGAUCUUCGAUUUAACC-5'  (SEQ ID NO: 627)
CKAP5-853 Target: 5'-CCCAACAAGAACTAGAAGCTAAATTGG-3' (SEQ ID NO: 1203)

5'-CAACAAGAACUAGAAGCUAAAUUGGAA-3'  (SEQ ID NO: 3508)
                3'-GUUGUUCUUGAUCUUCGAUUUAACCUU-5'  (SEQ ID NO: 628)
CKAP5-855 Target: 5'-CAACAAGAACTAGAAGCTAAATTGGAA-3' (SEQ ID NO: 1204)

5'-ACAACAGUCUGCUGGUGGAGAUGCUGA-3'  (SEQ ID NO: 3509)
                3'-UGUUGUCAGACGACCACCUCUACGACU-5'  (SEQ ID NO: 629)
CKAP5-884 Target: 5'-ACAACAGTCTGCTGGTGGAGATGCTGA-3' (SEQ ID NO: 1205)
```

TABLE 6-continued

Selected Human Anti-CKAP5 "Blunt/Blunt" DsiRNAs

|  |  |  |
|---|---|---|
|  | 5'-AACAGUCUGCUGGUGGAGAUGCUGAAG-3' | (SEQ ID NO: 3510) |
|  | 3'-UUGUCAGACGACCACCUCUACGACUUC-5' | (SEQ ID NO: 630) |
| CKAP5-886 Target: | 5'-AACAGTCTGCTGGTGGAGATGCTGAAG-3' | (SEQ ID NO: 1206) |
|  | 5'-AGGUGGUGAUGAUGGUGAUGAGGUGCC-3' | (SEQ ID NO: 3511) |
|  | 3'-UCCACCACUACUACCACUACUCCACGG-5' | (SEQ ID NO: 631) |
| CKAP5-914 Target: | 5'-AGGTGGTGATGATGGTGATGAGGTGCC-3' | (SEQ ID NO: 1207) |
|  | 5'-GUGGUGAUGAUGGUGAUGAGGUGCCAC-3' | (SEQ ID NO: 3512) |
|  | 3'-CACCACUACUACCACUACUCCACGGUG-5' | (SEQ ID NO: 632) |
| CKAP5-916 Target: | 5'-GTGGTGATGATGGTGATGAGGTGCCAC-3' | (SEQ ID NO: 1208) |
|  | 5'-AAAUCCUUUCCAAACUUCCCAAAGACU-3' | (SEQ ID NO: 3513) |
|  | 3'-UUUAGGAAAGGUUUGAAGGGUUUCUGA-5' | (SEQ ID NO: 633) |
| CKAP5-976 Target: | 5'-AAATCCTTTCCAAACTTCCCAAAGACT-3' | (SEQ ID NO: 1209) |
|  | 5'-AUCCUUUCCAAACUUCCCAAAGACUUU-3' | (SEQ ID NO: 3514) |
|  | 3'-UAGGAAAGGUUUGAAGGGUUUCUGAAA-5' | (SEQ ID NO: 634) |
| CKAP5-978 Target: | 5'-ATCCTTTCCAAACTTCCCAAAGACTTT-3' | (SEQ ID NO: 1210) |
|  | 5'-CCUUUCCAAACUUCCCAAAGACUUUUA-3' | (SEQ ID NO: 3515) |
|  | 3'-GGAAAGGUUUGAAGGGUUUCUGAAAAU-5' | (SEQ ID NO: 635) |
| CKAP5-980 Target: | 5'-CCTTTCCAAACTTCCCAAAGACTTTTA-3' | (SEQ ID NO: 1211) |
|  | 5'-UUUCCAAACUUCCCAAAGACUUUUAUG-3' | (SEQ ID NO: 3516) |
|  | 3'-AAAGGUUUGAAGGGUUUCUGAAAAUAC-5' | (SEQ ID NO: 636) |
| CKAP5-982 Target: | 5'-TTTCCAAACTTCCCAAAGACTTTTATG-3' | (SEQ ID NO: 1212) |
|  | 5'-UCCAAACUUCCCAAAGACUUUUAUGAC-3' | (SEQ ID NO: 3517) |
|  | 3'-AGGUUUGAAGGGUUUCUGAAAAUACUG-5' | (SEQ ID NO: 637) |
| CKAP5-984 Target: | 5'-TCCAAACTTCCCAAAGACTTTTATGAC-3' | (SEQ ID NO: 1213) |
|  | 5'-CAAACUUCCCAAAGACUUUUAUGACAA-3' | (SEQ ID NO: 3518) |
|  | 3'-GUUUGAAGGGUUUCUGAAAAUACUGUU-5' | (SEQ ID NO: 638) |
| CKAP5-986 Target: | 5'-CAAACTTCCCAAAGACTTTTATGACAA-3' | (SEQ ID NO: 1214) |
|  | 5'-AACUUCCCAAAGACUUUUAUGACAAAA-3' | (SEQ ID NO: 3519) |
|  | 3'-UUGAAGGGUUUCUGAAAAUACUGUUUU-5' | (SEQ ID NO: 639) |
| CKAP5-988 Target: | 5'-AACTTCCCAAAGACTTTTATGACAAAA-3' | (SEQ ID NO: 1215) |
|  | 5'-CUUCCCAAAGACUUUUAUGACAAAAUU-3' | (SEQ ID NO: 3520) |
|  | 3'-GAAGGGUUUCUGAAAAUACUGUUUUAA-5' | (SEQ ID NO: 640) |
| CKAP5-990 Target: | 5'-CTTCCCAAAGACTTTTATGACAAAATT-3' | (SEQ ID NO: 1216) |
|  | 5'-UCCCAAAGACUUUUAUGACAAAAUUGA-3' | (SEQ ID NO: 3521) |
|  | 3'-AGGGUUUCUGAAAAUACUGUUUUAACU-5' | (SEQ ID NO: 641) |
| CKAP5-992 Target: | 5'-TCCCAAAGACTTTTATGACAAAATTGA-3' | (SEQ ID NO: 1217) |
|  | 5'-CCAAAGACUUUUAUGACAAAAUUGAGG-3' | (SEQ ID NO: 3522) |
|  | 3'-GGUUUCUGAAAAUACUGUUUUAACUCC-5' | (SEQ ID NO: 642) |
| CKAP5-994 Target: | 5'-CCAAAGACTTTTATGACAAAATTGAGG-3' | (SEQ ID NO: 1218) |
|  | 5'-AAAGACUUUUAUGACAAAAUUGAGGCA-3' | (SEQ ID NO: 3523) |
|  | 3'-UUUCUGAAAAUACUGUUUUAACUCCGU-5' | (SEQ ID NO: 643) |
| CKAP5-996 Target: | 5'-AAAGACTTTTATGACAAAATTGAGGCA-3' | (SEQ ID NO: 1219) |
|  | 5'-AGACUUUUAUGACAAAAUUGAGGCAAA-3' | (SEQ ID NO: 3524) |
|  | 3'-UCUGAAAAUACUGUUUUAACUCCGUUU-5' | (SEQ ID NO: 644) |
| CKAP5-998 Target: | 5'-AGACTTTTATGACAAAATTGAGGCAAA-3' | (SEQ ID NO: 1220) |
|  | 5'-ACUUUUAUGACAAAAUUGAGGCAAAAA-3' | (SEQ ID NO: 3525) |
|  | 3'-UGAAAAUACUGUUUUAACUCCGUUUUU-5' | (SEQ ID NO: 645) |
| CKAP5-1000 Target: | 5'-ACTTTTATGACAAAATTGAGGCAAAAA-3' | (SEQ ID NO: 1221) |
|  | 5'-UUUUAUGACAAAAUUGAGGCAAAAAAA-3' | (SEQ ID NO: 3526) |
|  | 3'-AAAAUACUGUUUUAACUCCGUUUUUUU-5' | (SEQ ID NO: 646) |
| CKAP5-1002 Target: | 5'-TTTTATGACAAAATTGAGGCAAAAAAA-3' | (SEQ ID NO: 1222) |
|  | 5'-UUAUGACAAAAUUGAGGCAAAAAAAUG-3' | (SEQ ID NO: 3527) |
|  | 3'-AAUACUGUUUUAACUCCGUUUUUUUAC-5' | (SEQ ID NO: 647) |
| CKAP5-1004 Target: | 5'-TTATGACAAAATTGAGGCAAAAAAATG-3' | (SEQ ID NO: 1223) |
|  | 5'-AAAAUGGCAAGAGAGAAAAGAGGCCCU-3' | (SEQ ID NO: 3528) |
|  | 3'-UUUUACCGUUCUCUCUUUUCUCCGGGA-5' | (SEQ ID NO: 648) |
| CKAP5-1025 Target: | 5'-AAAATGGCAAGAGAGAAAAGAGGCCCT-3' | (SEQ ID NO: 1224) |

TABLE 6-continued

Selected Human Anti-CKAP5 "Blunt/Blunt" DsiRNAs

```
                5'-GAAGGUUGUUGGAAAGGACACCAAUGU-3'   (SEQ ID NO: 3529)
                3'-CUUCCAACAACCUUUCCUGUGGUUACA-5'   (SEQ ID NO: 649)
CKAP5-1127 Target:5'-GAAGGTTGTTGGAAAGGACACCAATGT-3' (SEQ ID NO: 1225)

5'-AGGUUGUUGGAAAGGACACCAAUGUCA-3'   (SEQ ID NO: 3530)
                3'-UCCAACAACCUUUCCUGUGGUUACAGU-5'   (SEQ ID NO: 650)
CKAP5-1129 Target:5'-AGGTTGTTGGAAAGGACACCAATGTCA-3' (SEQ ID NO: 1226)

5'-GUUGUUGGAAAGGACACCAAUGUCAUG-3'   (SEQ ID NO: 3531)
                3'-CAACAACCUUUCCUGUGGUUACAGUAC-5'   (SEQ ID NO: 651)
CKAP5-1131 Target:5'-GTTGTTGGAAAGGACACCAATGTCATG-3' (SEQ ID NO: 1227)

5'-UGUUGGAAAGGACACCAAUGUCAUGUU-3'   (SEQ ID NO: 3532)
                3'-ACAACCUUUCCUGUGGUUACAGUACAA-5'   (SEQ ID NO: 652)
CKAP5-1133 Target:5'-TGTTGGAAAGGACACCAATGTCATGTT-3' (SEQ ID NO: 1228)

5'-UUGGAAAGGACACCAAUGUCAUGUUGG-3'   (SEQ ID NO: 3533)
                3'-AACCUUUCCUGUGGUUACAGUACAACC-5'   (SEQ ID NO: 653)
CKAP5-1135 Target:5'-TTGGAAAGGACACCAATGTCATGTTGG-3' (SEQ ID NO: 1229)

5'-GGAAAGGACACCAAUGUCAUGUUGGUG-3'   (SEQ ID NO: 3534)
                3'-CCUUUCCUGUGGUUACAGUACAACCAC-5'   (SEQ ID NO: 654)
CKAP5-1137 Target:5'-GGAAAGGACACCAATGTCATGTTGGTG-3' (SEQ ID NO: 1230)

5'-AAAGGACACCAAUGUCAUGUUGGUGGC-3'   (SEQ ID NO: 3535)
                3'-UUUCCUGUGGUUACAGUACAACCACCG-5'   (SEQ ID NO: 655)
CKAP5-1139 Target:5'-AAAGGACACCAATGTCATGTTGGTGGC-3' (SEQ ID NO: 1231)

5'-AGGACACCAAUGUCAUGUUGGUGGCUU-3'   (SEQ ID NO: 3536)
                3'-UCCUGUGGUUACAGUACAACCACCGAA-5'   (SEQ ID NO: 656)
CKAP5-1141 Target:5'-AGGACACCAATGTCATGTTGGTGGCTT-3' (SEQ ID NO: 1232)

5'-UGGCUUUGGCAGCAAAAUGUCUUACUG-3'   (SEQ ID NO: 3537)
                3'-ACCGAAACCGUCGUUUUACAGAAUGAC-5'   (SEQ ID NO: 657)
CKAP5-1162 Target:5'-TGGCTTTGGCAGCAAAATGTCTTACTG-3' (SEQ ID NO: 1233)

5'-GCUUUGGCAGCAAAAUGUCUUACUGGC-3'   (SEQ ID NO: 3538)
                3'-CGAAACCGUCGUUUUACAGAAUGACCG-5'   (SEQ ID NO: 658)
CKAP5-1164 Target:5'-GCTTTGGCAGCAAAATGTCTTACTGGC-3' (SEQ ID NO: 1234)

5'-UUUGGCAGCAAAAUGUCUUACUGGCCU-3'   (SEQ ID NO: 3539)
                3'-AAACCGUCGUUUUACAGAAUGACCGGA-5'   (SEQ ID NO: 659)
CKAP5-1166 Target:5'-TTTGGCAGCAAAATGTCTTACTGGCCT-3' (SEQ ID NO: 1235)

5'-UGGCAGCAAAAUGUCUUACUGGCCUGG-3'   (SEQ ID NO: 3540)
                3'-ACCGUCGUUUUACAGAAUGACCGGACC-5'   (SEQ ID NO: 660)
CKAP5-1168 Target:5'-TGGCAGCAAAATGTCTTACTGGCCTGG-3' (SEQ ID NO: 1236)

5'-GCAGCAAAAUGUCUUACUGGCCUGGCU-3'   (SEQ ID NO: 3541)
                3'-CGUCGUUUUACAGAAUGACCGGACCGA-5'   (SEQ ID NO: 661)
CKAP5-1170 Target:5'-GCAGCAAAATGTCTTACTGGCCTGGCT-3' (SEQ ID NO: 1237)

5'-GAAGAAAUUUGGACAAUAUGCAGGACA-3'   (SEQ ID NO: 3542)
                3'-CUUCUUUAAACCUGUUAUACGUCCUGU-5'   (SEQ ID NO: 662)
CKAP5-1208 Target:5'-GAAGAAATTTGGACAATATGCAGGACA-3' (SEQ ID NO: 1238)

5'-AGAAAUUUGGACAAUAUGCAGGACAUG-3'   (SEQ ID NO: 3543)
                3'-UCUUUAAACCUGUUAUACGUCCUGUAC-5'   (SEQ ID NO: 663)
CKAP5-1210 Target:5'-AGAAATTTGGACAATATGCAGGACATG-3' (SEQ ID NO: 1239)

5'-AAAUUUGGACAAUAUGCAGGACAUGUU-3'   (SEQ ID NO: 3544)
                3'-UUUAAACCUGUUAUACGUCCUGUACAA-5'   (SEQ ID NO: 664)
CKAP5-1212 Target:5'-AAATTTGGACAATATGCAGGACATGTT-3' (SEQ ID NO: 1240)

5'-AUUUGGACAAUAUGCAGGACAUGUUGU-3'   (SEQ ID NO: 3545)
                3'-UAAACCUGUUAUACGUCCUGUACAACA-5'   (SEQ ID NO: 665)
CKAP5-1214 Target:5'-ATTTGGACAATATGCAGGACATGTTGT-3' (SEQ ID NO: 1241)

5'-UUGGACAAUAUGCAGGACAUGUUGUGC-3'   (SEQ ID NO: 3546)
                3'-AACCUGUUAUACGUCCUGUACAACACG-5'   (SEQ ID NO: 666)
CKAP5-1216 Target:5'-TTGGACAATATGCAGGACATGTTGTGC-3' (SEQ ID NO: 1242)

5'-GGACAAUAUGCAGGACAUGUUGUGCCA-3'   (SEQ ID NO: 3547)
                3'-CCUGUUAUACGUCCUGUACAACACGGU-5'   (SEQ ID NO: 667)
CKAP5-1218 Target:5'-GGACAATATGCAGGACATGTTGTGCCA-3' (SEQ ID NO: 1243)
```

TABLE 6-continued

Selected Human Anti-CKAP5 "Blunt/Blunt" DsiRNAs

|  |  |  |
|---|---|---|
| | 5'-ACAAUAUGCAGGACAUGUUGUGCCAAC-3' | (SEQ ID NO: 3548) |
| | 3'-UGUUAUACGUCCUGUACAACACGGUUG-5' | (SEQ ID NO: 668) |
| CKAP5-1220 Target: | 5'-ACAATATGCAGGACATGTTGTGCCAAC-3' | (SEQ ID NO: 1244) |
| | 5'-AAUAUGCAGGACAUGUUGUGCCAACCA-3' | (SEQ ID NO: 3549) |
| | 3'-UUAUACGUCCUGUACAACACGGUUGGU-5' | (SEQ ID NO: 669) |
| CKAP5-1222 Target: | 5'-AATATGCAGGACATGTTGTGCCAACCA-3' | (SEQ ID NO: 1245) |
| | 5'-UAUGCAGGACAUGUUGUGCCAACCAUC-3' | (SEQ ID NO: 3550) |
| | 3'-AUACGUCCUGUACAACACGGUUGGUAG-5' | (SEQ ID NO: 670) |
| CKAP5-1224 Target: | 5'-TATGCAGGACATGTTGTGCCAACCATC-3' | (SEQ ID NO: 1246) |
| | 5'-UGCAGGACAUGUUGUGCCAACCAUCUU-3' | (SEQ ID NO: 3551) |
| | 3'-ACGUCCUGUACAACACGGUUGGUAGAA-5' | (SEQ ID NO: 671) |
| CKAP5-1226 Target: | 5'-TGCAGGACATGTTGTGCCAACCATCTT-3' | (SEQ ID NO: 1247) |
| | 5'-ACCUCAAGUGGUACAAGCCCUGCAGGA-3' | (SEQ ID NO: 3552) |
| | 3'-UGGAGUUCACCAUGUUCGGGACGUCCU-5' | (SEQ ID NO: 672) |
| CKAP5-1274 Target: | 5'-ACCTCAAGTGGTACAAGCCCTGCAGGA-3' | (SEQ ID NO: 1248) |
| | 5'-CUCAAGUGGUACAAGCCCUGCAGGAGG-3' | (SEQ ID NO: 3553) |
| | 3'-GAGUUCACCAUGUUCGGGACGUCCUCC-5' | (SEQ ID NO: 673) |
| CKAP5-1276 Target: | 5'-CTCAAGTGGTACAAGCCCTGCAGGAGG-3' | (SEQ ID NO: 1249) |
| | 5'-CAAGUGGUACAAGCCCUGCAGGAGGCA-3' | (SEQ ID NO: 3554) |
| | 3'-GUUCACCAUGUUCGGGACGUCCUCCGU-5' | (SEQ ID NO: 674) |
| CKAP5-1278 Target: | 5'-CAAGTGGTACAAGCCCTGCAGGAGGCA-3' | (SEQ ID NO: 1250) |
| | 5'-AGUGGUACAAGCCCUGCAGGAGGCAAU-3' | (SEQ ID NO: 3555) |
| | 3'-UCACCAUGUUCGGGACGUCCUCCGUUA-5' | (SEQ ID NO: 675) |
| CKAP5-1280 Target: | 5'-AGTGGTACAAGCCCTGCAGGAGGCAAT-3' | (SEQ ID NO: 1251) |
| | 5'-UGGUACAAGCCCUGCAGGAGGCAAUUG-3' | (SEQ ID NO: 3556) |
| | 3'-ACCAUGUUCGGGACGUCCUCCGUUAAC-5' | (SEQ ID NO: 676) |
| CKAP5-1282 Target: | 5'-TGGTACAAGCCCTGCAGGAGGCAATTG-3' | (SEQ ID NO: 1252) |
| | 5'-GUACAAGCCCUGCAGGAGGCAAUUGAU-3' | (SEQ ID NO: 3557) |
| | 3'-CAUGUUCGGGACGUCCUCCGUUAACUA-5' | (SEQ ID NO: 677) |
| CKAP5-1284 Target: | 5'-GTACAAGCCCTGCAGGAGGCAATTGAT-3' | (SEQ ID NO: 1253) |
| | 5'-ACAAGCCCUGCAGGAGGCAAUUGAUGC-3' | (SEQ ID NO: 3558) |
| | 3'-UGUUCGGGACGUCCUCCGUUAACUACG-5' | (SEQ ID NO: 678) |
| CKAP5-1286 Target: | 5'-ACAAGCCCTGCAGGAGGCAATTGATGC-3' | (SEQ ID NO: 1254) |
| | 5'-AAGCCCUGCAGGAGGCAAUUGAUGCAA-3' | (SEQ ID NO: 3559) |
| | 3'-UUCGGGACGUCCUCCGUUAACUACGUU-5' | (SEQ ID NO: 679) |
| CKAP5-1288 Target: | 5'-AAGCCCTGCAGGAGGCAATTGATGCAA-3' | (SEQ ID NO: 1255) |
| | 5'-GCCCUGCAGGAGGCAAUUGAUGCAAUC-3' | (SEQ ID NO: 3560) |
| | 3'-CGGGACGUCCUCCGUUAACUACGUUAG-5' | (SEQ ID NO: 680) |
| CKAP5-1290 Target: | 5'-GCCCTGCAGGAGGCAATTGATGCAATC-3' | (SEQ ID NO: 1256) |
| | 5'-CCUGCAGGAGGCAAUUGAUGCAAUCUU-3' | (SEQ ID NO: 3561) |
| | 3'-GGACGUCCUCCGUUAACUACGUUAGAA-5' | (SEQ ID NO: 681) |
| CKAP5-1292 Target: | 5'-CCTGCAGGAGGCAATTGATGCAATCTT-3' | (SEQ ID NO: 1257) |
| | 5'-UGCAGGAGGCAAUUGAUGCAAUCUUCC-3' | (SEQ ID NO: 3562) |
| | 3'-ACGUCCUCCGUUAACUACGUUAGAAGG-5' | (SEQ ID NO: 682) |
| CKAP5-1294 Target: | 5'-TGCAGGAGGCAATTGATGCAATCTTCC-3' | (SEQ ID NO: 1258) |
| | 5'-CAGGAGGCAAUUGAUGCAAUCUUCCUU-3' | (SEQ ID NO: 3563) |
| | 3'-GUCCUCCGUUAACUACGUUAGAAGGAA-5' | (SEQ ID NO: 683) |
| CKAP5-1296 Target: | 5'-CAGGAGGCAATTGATGCAATCTTCCTT-3' | (SEQ ID NO: 1259) |
| | 5'-GGAGGCAAUUGAUGCAAUCUUCCUUAC-3' | (SEQ ID NO: 3564) |
| | 3'-CCUCCGUUAACUACGUUAGAAGGAAUG-5' | (SEQ ID NO: 684) |
| CKAP5-1298 Target: | 5'-GGAGGCAATTGATGCAATCTTCCTTAC-3' | (SEQ ID NO: 1260) |
| | 5'-AGGCAAUUGAUGCAAUCUUCCUUACUA-3' | (SEQ ID NO: 3565) |
| | 3'-UCCGUUAACUACGUUAGAAGGAAUGAU-5' | (SEQ ID NO: 685) |
| CKAP5-1300 Target: | 5'-AGGCAATTGATGCAATCTTCCTTACTA-3' | (SEQ ID NO: 1261) |
| | 5'-UUACUACCACACUACAGAACAUCAGUG-3' | (SEQ ID NO: 3566) |
| | 3'-AAUGAUGGUGUGAUGUCUUGUAGUCAC-5' | (SEQ ID NO: 686) |
| CKAP5-1321 Target: | 5'-TTACTACCACACTACAGAACATCAGTG-3' | (SEQ ID NO: 1262) |

TABLE 6-continued

Selected Human Anti-CKAP5 "Blunt/Blunt" DsiRNAs

```
                    5'-ACUACCACACUACAGAACAUCAGUGAG-3'    (SEQ ID NO: 3567)
                    3'-UGAUGGUGUGAUGUCUUGUAGUCACUC-5'    (SEQ ID NO: 687)
CKAP5-1323 Target: 5'-ACTACCACACTACAGAACATCAGTGAG-3'     (SEQ ID NO: 1263)

5'-UACCACACUACAGAACAUCAGUGAGGA-3'    (SEQ ID NO: 3568)
                    3'-AUGGUGUGAUGUCUUGUAGUCACUCCU-5'    (SEQ ID NO: 688)
CKAP5-1325 Target: 5'-TACCACACTACAGAACATCAGTGAGGA-3'     (SEQ ID NO: 1264)

5'-CCACACUACAGAACAUCAGUGAGGAUG-3'    (SEQ ID NO: 3569)
                    3'-GGUGUGAUGUCUUGUAGUCACUCCUAC-5'    (SEQ ID NO: 689)
CKAP5-1327 Target: 5'-CCACACTACAGAACATCAGTGAGGATG-3'     (SEQ ID NO: 1265)

5'-ACACUACAGAACAUCAGUGAGGAUGUU-3'    (SEQ ID NO: 3570)
                    3'-UGUGAUGUCUUGUAGUCACUCCUACAA-5'    (SEQ ID NO: 690)
CKAP5-1329 Target: 5'-ACACTACAGAACATCAGTGAGGATGTT-3'     (SEQ ID NO: 1266)

5'-ACUACAGAACAUCAGUGAGGAUGUUUU-3'    (SEQ ID NO: 3571)
                    3'-UGAUGUCUUGUAGUCACUCCUACAAAA-5'    (SEQ ID NO: 691)
CKAP5-1331 Target: 5'-ACTACAGAACATCAGTGAGGATGTTTT-3'     (SEQ ID NO: 1267)

5'-UACAGAACAUCAGUGAGGAUGUUUUAG-3'    (SEQ ID NO: 3572)
                    3'-AUGUCUUGUAGUCACUCCUACAAAAUC-5'    (SEQ ID NO: 692)
CKAP5-1333 Target: 5'-TACAGAACATCAGTGAGGATGTTTTAG-3'     (SEQ ID NO: 1268)

5'-UUUUAGCAGUAAUGGAUAAUAAAAAUC-3'    (SEQ ID NO: 3573)
                    3'-AAAAUCGUCAUUACCUAUUAUUUUUAG-5'    (SEQ ID NO: 693)
CKAP5-1354 Target: 5'-TTTTAGCAGTAATGGATAATAAAAATC-3'     (SEQ ID NO: 1269)

5'-UUAGCAGUAAUGGAUAAUAAAAAUCCA-3'    (SEQ ID NO: 3574)
                    3'-AAUCGUCAUUACCUAUUAUUUUUAGGU-5'    (SEQ ID NO: 694)
CKAP5-1356 Target: 5'-TTAGCAGTAATGGATAATAAAAATCCA-3'     (SEQ ID NO: 1270)

5'-AGCAGUAAUGGAUAAUAAAAAUCCAAC-3'    (SEQ ID NO: 3575)
                    3'-UCGUCAUUACCUAUUAUUUUUAGGUUG-5'    (SEQ ID NO: 695)
CKAP5-1358 Target: 5'-AGCAGTAATGGATAATAAAAATCCAAC-3'     (SEQ ID NO: 1271)

5'-CAGUAAUGGAUAAUAAAAAUCCAACCA-3'    (SEQ ID NO: 3576)
                    3'-GUCAUUACCUAUUAUUUUUAGGUUGGU-5'    (SEQ ID NO: 696)
CKAP5-1360 Target: 5'-CAGTAATGGATAATAAAAATCCAACCA-3'     (SEQ ID NO: 1272)

5'-CAACCAUCAAGCAGCAGACAUCUCUUU-3'    (SEQ ID NO: 3577)
                    3'-GUUGGUAGUUCGUCGUCUGUAGAGAAA-5'    (SEQ ID NO: 697)
CKAP5-1381 Target: 5'-CAACCATCAAGCAGCAGACATCTCTTT-3'     (SEQ ID NO: 1273)

5'-CACUACUUAAGCACAUCAAUGAUUCUG-3'    (SEQ ID NO: 3578)
                    3'-GUGAUGAAUUCGUGUAGUUACUAAGAC-5'    (SEQ ID NO: 698)
CKAP5-1480 Target: 5'-CACTACTTAAGCACATCAATGATTCTG-3'     (SEQ ID NO: 1274)

5'-CUACUUAAGCACAUCAAUGAUUCUGCU-3'    (SEQ ID NO: 3579)
                    3'-GAUGAAUUCGUGUAGUUACUAAGACGA-5'    (SEQ ID NO: 699)
CKAP5-1482 Target: 5'-CTACTTAAGCACATCAATGATTCTGCT-3'     (SEQ ID NO: 1275)

5'-ACUUAAGCACAUCAAUGAUUCUGCUCC-3'    (SEQ ID NO: 3580)
                    3'-UGAAUUCGUGUAGUUACUAAGACGAGG-5'    (SEQ ID NO: 700)
CKAP5-1484 Target: 5'-ACTTAAGCACATCAATGATTCTGCTCC-3'     (SEQ ID NO: 1276)

5'-UUAAGCACAUCAAUGAUUCUGCUCCUG-3'    (SEQ ID NO: 3581)
                    3'-AAUUCGUGUAGUUACUAAGACGAGGAC-5'    (SEQ ID NO: 701)
CKAP5-1486 Target: 5'-TTAAGCACATCAATGATTCTGCTCCTG-3'     (SEQ ID NO: 1277)

5'-AAGCACAUCAAUGAUUCUGCUCCUGAA-3'    (SEQ ID NO: 3582)
                    3'-UUCGUGUAGUUACUAAGACGAGGACUU-5'    (SEQ ID NO: 702)
CKAP5-1488 Target: 5'-AAGCACATCAATGATTCTGCTCCTGAA-3'     (SEQ ID NO: 1278)

5'-GCACAUCAAUGAUUCUGCUCCUGAAGU-3'    (SEQ ID NO: 3583)
                    3'-CGUGUAGUUACUAAGACGAGGACUUCA-5'    (SEQ ID NO: 703)
CKAP5-1490 Target: 5'-GCACATCAATGATTCTGCTCCTGAAGT-3'     (SEQ ID NO: 1279)

5'-ACAUCAAUGAUUCUGCUCCUGAAGUCA-3'    (SEQ ID NO: 3584)
                    3'-UGUAGUUACUAAGACGAGGACUUCAGU-5'    (SEQ ID NO: 704)
CKAP5-1492 Target: 5'-ACATCAATGATTCTGCTCCTGAAGTCA-3'     (SEQ ID NO: 1280)

5'-AUCAAUGAUUCUGCUCCUGAAGUCAGA-3'    (SEQ ID NO: 3585)
                    3'-UAGUUACUAAGACGAGGACUUCAGUCU-5'    (SEQ ID NO: 705)
CKAP5-1494 Target: 5'-ATCAATGATTCTGCTCCTGAAGTCAGA-3'     (SEQ ID NO: 1281)
```

TABLE 6-continued

Selected Human Anti-CKAP5 "Blunt/Blunt" DsiRNAs

|  |  |  |
|---|---|---|
|  | 5'-CAAUGAUUCUGCUCCUGAAGUCAGAGA-3' | (SEQ ID NO: 3586) |
|  | 3'-GUUACUAAGACGAGGACUUCAGUCUCU-5' | (SEQ ID NO: 706) |
| CKAP5-1496 Target: | 5'-CAATGATTCTGCTCCTGAAGTCAGAGA-3' | (SEQ ID NO: 1282) |
|  | 5'-AUGAUUCUGCUCCUGAAGUCAGAGAUG-3' | (SEQ ID NO: 3587) |
|  | 3'-UACUAAGACGAGGACUUCAGUCUCUAC-5' | (SEQ ID NO: 707) |
| CKAP5-1498 Target: | 5'-ATGATTCTGCTCCTGAAGTCAGAGATG-3' | (SEQ ID NO: 1283) |
|  | 5'-GAUUCUGCUCCUGAAGUCAGAGAUGCC-3' | (SEQ ID NO: 3588) |
|  | 3'-CUAAGACGAGGACUUCAGUCUCUACGG-5' | (SEQ ID NO: 708) |
| CKAP5-1500 Target: | 5'-GATTCTGCTCCTGAAGTCAGAGATGCC-3' | (SEQ ID NO: 1284) |
|  | 5'-UUCUGCUCCUGAAGUCAGAGAUGCCGC-3' | (SEQ ID NO: 3589) |
|  | 3'-AAGACGAGGACUUCAGUCUCUACGGCG-5' | (SEQ ID NO: 709) |
| CKAP5-1502 Target: | 5'-TTCTGCTCCTGAAGTCAGAGATGCCGC-3' | (SEQ ID NO: 1285) |
|  | 5'-CUGCUCCUGAAGUCAGAGAUGCCGCAU-3' | (SEQ ID NO: 3590) |
|  | 3'-GACGAGGACUUCAGUCUCUACGGCGUA-5' | (SEQ ID NO: 710) |
| CKAP5-1504 Target: | 5'-CTGCTCCTGAAGTCAGAGATGCCGCAT-3' | (SEQ ID NO: 1286) |
|  | 5'-AAGAUCAAAGAAUGUUCAGAAAAGGUA-3' | (SEQ ID NO: 3591) |
|  | 3'-UUCUAGUUUCUUACAAGUCUUUUCCAU-5' | (SEQ ID NO: 711) |
| CKAP5-1617 Target: | 5'-AAGATCAAAGAATGTTCAGAAAAGGTA-3' | (SEQ ID NO: 1287) |
|  | 5'-GAUCAAAGAAUGUUCAGAAAAGGUAGA-3' | (SEQ ID NO: 3592) |
|  | 3'-CUAGUUUCUUACAAGUCUUUUCCAUCU-5' | (SEQ ID NO: 712) |
| CKAP5-1619 Target: | 5'-GATCAAAGAATGTTCAGAAAAGGTAGA-3' | (SEQ ID NO: 1288) |
|  | 5'-GAAACCUGGAUGGAAAGAAACUAAUUU-3' | (SEQ ID NO: 3593) |
|  | 3'-CUUUGGACCUACCUUUCUUUGAUUAAA-5' | (SEQ ID NO: 713) |
| CKAP5-2090 Target: | 5'-GAAACCTGGATGGAAAGAAACTAATTT-3' | (SEQ ID NO: 1289) |
|  | 5'-AACCUGGAUGGAAAGAAACUAAUUUUC-3' | (SEQ ID NO: 3594) |
|  | 3'-UUGGACCUACCUUUCUUUGAUUAAAAG-5' | (SEQ ID NO: 714) |
| CKAP5-2092 Target: | 5'-AACCTGGATGGAAAGAAACTAATTTTC-3' | (SEQ ID NO: 1290) |
|  | 5'-CCUGGAUGGAAAGAAACUAAUUUUCAG-3' | (SEQ ID NO: 3595) |
|  | 3'-GGACCUACCUUUCUUUGAUUAAAAGUC-5' | (SEQ ID NO: 715) |
| CKAP5-2094 Target: | 5'-CCTGGATGGAAAGAAACTAATTTTCAG-3' | (SEQ ID NO: 1291) |
|  | 5'-UGGAUGGAAAGAAACUAAUUUUCAGGU-3' | (SEQ ID NO: 3596) |
|  | 3'-ACCUACCUUUCUUUGAUUAAAAGUCCA-5' | (SEQ ID NO: 716) |
| CKAP5-2096 Target: | 5'-TGGATGGAAAGAAACTAATTTTCAGGT-3' | (SEQ ID NO: 1292) |
|  | 5'-GAUGGAAAGAAACUAAUUUUCAGGUGA-3' | (SEQ ID NO: 3597) |
|  | 3'-CUACCUUUCUUUGAUUAAAAGUCCACU-5' | (SEQ ID NO: 717) |
| CKAP5-2098 Target: | 5'-GATGGAAAGAAACTAATTTTCAGGTGA-3' | (SEQ ID NO: 1293) |
|  | 5'-UGGAAAGAAACUAAUUUUCAGGUGAUG-3' | (SEQ ID NO: 3598) |
|  | 3'-ACCUUUCUUUGAUUAAAAGUCCACUAC-5' | (SEQ ID NO: 718) |
| CKAP5-2100 Target: | 5'-TGGAAAGAAACTAATTTTCAGGTGATG-3' | (SEQ ID NO: 1294) |
|  | 5'-GAAAGAAACUAAUUUUCAGGUGAUGCA-3' | (SEQ ID NO: 3599) |
|  | 3'-CUUUCUUUGAUUAAAAGUCCACUACGU-5' | (SEQ ID NO: 719) |
| CKAP5-2102 Target: | 5'-GAAAGAAACTAATTTTCAGGTGATGCA-3' | (SEQ ID NO: 1295) |
|  | 5'-AAGAAACUAAUUUUCAGGUGAUGCAAA-3' | (SEQ ID NO: 3600) |
|  | 3'-UUCUUUGAUUAAAAGUCCACUACGUUU-5' | (SEQ ID NO: 720) |
| CKAP5-2104 Target: | 5'-AAGAAACTAATTTTCAGGTGATGCAAA-3' | (SEQ ID NO: 1296) |
|  | 5'-GAAACUAAUUUUCAGGUGAUGCAAAUG-3' | (SEQ ID NO: 3601) |
|  | 3'-CUUUGAUUAAAAGUCCACUACGUUUAC-5' | (SEQ ID NO: 721) |
| CKAP5-2106 Target: | 5'-GAAACTAATTTTCAGGTGATGCAAATG-3' | (SEQ ID NO: 1297) |
|  | 5'-AACUAAUUUUCAGGUGAUGCAAAUGAA-3' | (SEQ ID NO: 3602) |
|  | 3'-UUGAUUAAAAGUCCACUACGUUUACUU-5' | (SEQ ID NO: 722) |
| CKAP5-2108 Target: | 5'-AACTAATTTTCAGGTGATGCAAATGAA-3' | (SEQ ID NO: 1298) |
|  | 5'-AGUUGCUUUGAUUGCCCAGAAGGGAAA-3' | (SEQ ID NO: 3603) |
|  | 3'-UCAACGAAACUAACGGGUCUUCCCUUU-5' | (SEQ ID NO: 723) |
| CKAP5-2144 Target: | 5'-AGTTGCTTTGATTGCCCAGAAGGGAAA-3' | (SEQ ID NO: 1299) |
|  | 5'-UUGCUUUGAUUGCCCAGAAGGGAAAUU-3' | (SEQ ID NO: 3604) |
|  | 3'-AACGAAACUAACGGGUCUUCCCUUUAA-5' | (SEQ ID NO: 724) |
| CKAP5-2146 Target: | 5'-TTGCTTTGATTGCCCAGAAGGGAAATT-3' | (SEQ ID NO: 1300) |

TABLE 6-continued

Selected Human Anti-CKAP5 "Blunt/Blunt" DsiRNAs

```
                 5'-GCUUUGAUUGCCCAGAAGGGAAAUUUU-3'   (SEQ ID NO: 3605)
                 3'-CGAAACUAACGGGUCUUCCCUUUAAAA-5'   (SEQ ID NO: 725)
CKAP5-2148 Target:5'-GCTTTGATTGCCCAGAAGGGAAATTTT-3'   (SEQ ID NO: 1301)

5'-UUUGAUUGCCCAGAAGGGAAAUUUUUC-3'   (SEQ ID NO: 3606)
                 3'-AAACUAACGGGUCUUCCCUUUAAAAAG-5'   (SEQ ID NO: 726)
CKAP5-2150 Target:5'-TTTGATTGCCCAGAAGGGAAATTTTTC-3'   (SEQ ID NO: 1302)

5'-UGAUUGCCCAGAAGGGAAAUUUUUCCA-3'   (SEQ ID NO: 3607)
                 3'-ACUAACGGGUCUUCCCUUUAAAAAGGU-5'   (SEQ ID NO: 727)
CKAP5-2152 Target:5'-TGATTGCCCAGAAGGGAAATTTTTCCA-3'   (SEQ ID NO: 1303)

5'-AUUGCCCAGAAGGGAAAUUUUUCCAAA-3'   (SEQ ID NO: 3608)
                 3'-UAACGGGUCUUCCCUUUAAAAAGGUUU-5'   (SEQ ID NO: 728)
CKAP5-2154 Target:5'-ATTGCCCAGAAGGGAAATTTTTCCAAA-3'   (SEQ ID NO: 1304)

5'-UGCCCAGAAGGGAAAUUUUUCCAAAC-3'    (SEQ ID NO: 3609)
                 3'-ACGGGUCUUCCCUUUAAAAAGGUUUUG-5'   (SEQ ID NO: 729)
CKAP5-2156 Target:5'-TGCCCAGAAGGGAAATTTTTCCAAAC-3'    (SEQ ID NO: 1305)

5'-UGGACAAGAUUGGAGAUGUGAAAUGUG-3'   (SEQ ID NO: 3610)
                 3'-ACCUGUUCUAACCUCUACACUUUACAC-5'   (SEQ ID NO: 730)
CKAP5-2212 Target:5'-TGGACAAGATTGGAGATGTGAAATGTG-3'   (SEQ ID NO: 1306)

5'-GACAAGAUUGGAGAUGUGAAAUGUGGG-3'   (SEQ ID NO: 3611)
                 3'-CUGUUCUAACCUCUACACUUUACACCC-5'   (SEQ ID NO: 731)
CKAP5-2214 Target:5'-GACAAGATTGGAGATGTGAAATGTGGG-3'   (SEQ ID NO: 1307)

5'-CAAGAUUGGAGAUGUGAAAUGUGGGAA-3'   (SEQ ID NO: 3612)
                 3'-GUUCUAACCUCUACACUUUACACCCUU-5'   (SEQ ID NO: 732)
CKAP5-2216 Target:5'-CAAGATTGGAGATGTGAAATGTGGGAA-3'   (SEQ ID NO: 1308)

5'-AGAUUGGAGAUGUGAAAUGUGGGAACA-3'   (SEQ ID NO: 3613)
                 3'-UCUAACCUCUACACUUUACACCCUUGU-5'   (SEQ ID NO: 733)
CKAP5-2218 Target:5'-AGATTGGAGATGTGAAATGTGGGAACA-3'   (SEQ ID NO: 1309)

5'-AUUGGAGAUGUGAAAUGUGGGAACAAU-3'   (SEQ ID NO: 3614)
                 3'-UAACCUCUACACUUUACACCCUUGUUA-5'   (SEQ ID NO: 734)
CKAP5-2220 Target:5'-ATTGGAGATGTGAAATGTGGGAACAAT-3'   (SEQ ID NO: 1310)

5'-UGGAGAUGUGAAAUGUGGGAACAAUGC-3'   (SEQ ID NO: 3615)
                 3'-ACCUCUACACUUUACACCCUUGUUACG-5'   (SEQ ID NO: 735)
CKAP5-2222 Target:5'-TGGAGATGTGAAATGTGGGAACAATGC-3'   (SEQ ID NO: 1311)

5'-GAGAUGUGAAAUGUGGGAACAAUGCAA-3'   (SEQ ID NO: 3616)
                 3'-CUCUACACUUUACACCCUUGUUACGUU-5'   (SEQ ID NO: 736)
CKAP5-2224 Target:5'-GAGATGTGAAATGTGGGAACAATGCAA-3'   (SEQ ID NO: 1312)

5'-GAUGUGAAAUGUGGGAACAAUGCAAAA-3'   (SEQ ID NO: 3617)
                 3'-CUACACUUUACACCCUUGUUACGUUUU-5'   (SEQ ID NO: 737)
CKAP5-2226 Target:5'-GATGTGAAATGTGGGAACAATGCAAAA-3'   (SEQ ID NO: 1313)

5'-UGUGAAAUGUGGGAACAAUGCAAAAGA-3'   (SEQ ID NO: 3618)
                 3'-ACACUUUACACCCUUGUUACGUUUUCU-5'   (SEQ ID NO: 738)
CKAP5-2228 Target:5'-TGTGAAATGTGGGAACAATGCAAAAGA-3'   (SEQ ID NO: 1314)

5'-UGAAAUGUGGGAACAAUGCAAAAGAAG-3'   (SEQ ID NO: 3619)
                 3'-ACUUUACACCCUUGUUACGUUUUCUUC-5'   (SEQ ID NO: 739)
CKAP5-2230 Target:5'-TGAAATGTGGGAACAATGCAAAAGAAG-3'   (SEQ ID NO: 1315)

5'-AAAUGUGGGAACAAUGCAAAAGAAGCU-3'   (SEQ ID NO: 3620)
                 3'-UUUACACCCUUGUUACGUUUUCUUCGA-5'   (SEQ ID NO: 740)
CKAP5-2232 Target:5'-AAATGTGGGAACAATGCAAAAGAAGCT-3'   (SEQ ID NO: 1316)

5'-AUGUGGGAACAAUGCAAAAGAAGCUAU-3'   (SEQ ID NO: 3621)
                 3'-UACACCCUUGUUACGUUUUCUUCGAUA-5'   (SEQ ID NO: 741)
CKAP5-2234 Target:5'-ATGTGGGAACAATGCAAAAGAAGCTAT-3'   (SEQ ID NO: 1317)

5'-GUGGGAACAAUGCAAAAGAAGCUAUGA-3'   (SEQ ID NO: 3622)
                 3'-CACCCUUGUUACGUUUUCUUCGAUACU-5'   (SEQ ID NO: 742)
CKAP5-2236 Target:5'-GTGGGAACAATGCAAAAGAAGCTATGA-3'   (SEQ ID NO: 1318)

5'-GGGUUGAAUGUCAAAGCUUUCAUUAGC-3'   (SEQ ID NO: 3623)
                 3'-CCCAACUUACAGUUUCGAAAGUAAUCG-5'   (SEQ ID NO: 743)
CKAP5-2400 Target:5'-GGGTTGAATGTCAAAGCTTTCATTAGC-3'   (SEQ ID NO: 1319)
```

TABLE 6-continued

Selected Human Anti-CKAP5 "Blunt/Blunt" DsiRNAs

```
                5'-GUUGAAUGUCAAAGCUUUCAUUAGCAA-3'   (SEQ ID NO: 3624)
                3'-CAACUUACAGUUUCGAAAGUAAUCGUU-5'   (SEQ ID NO: 744)
CKAP5-2402 Target:5'-GTTGAATGTCAAAGCTTTCATTAGCAA-3' (SEQ ID NO: 1320)

5'-UGAAUGUCAAAGCUUUCAUUAGCAAUG-3'   (SEQ ID NO: 3625)
                3'-ACUUACAGUUUCGAAAGUAAUCGUUAC-5'   (SEQ ID NO: 745)
CKAP5-2404 Target:5'-TGAATGTCAAAGCTTTCATTAGCAATG-3' (SEQ ID NO: 1321)

5'-AAUGUCAAAGCUUUCAUUAGCAAUGUG-3'   (SEQ ID NO: 3626)
                3'-UUACAGUUUCGAAAGUAAUCGUUACAC-5'   (SEQ ID NO: 746)
CKAP5-2406 Target:5'-AATGTCAAAGCTTTCATTAGCAATGTG-3' (SEQ ID NO: 1322)

5'-UGUCAAAGCUUUCAUUAGCAAUGUGAA-3'   (SEQ ID NO: 3627)
                3'-ACAGUUUCGAAAGUAAUCGUUACACUU-5'   (SEQ ID NO: 747)
CKAP5-2408 Target:5'-TGTCAAAGCTTTCATTAGCAATGTGAA-3' (SEQ ID NO: 1323)

5'-AACCCUGCUUGGCGUGAUGUAUCUGUA-3'   (SEQ ID NO: 3628)
                3'-UUGGGACGAACCGCACUACAUAGACAU-5'   (SEQ ID NO: 748)
CKAP5-2480 Target:5'-AACCCTGCTTGGCGTGATGTATCTGTA-3' (SEQ ID NO: 1324)

5'-CCCUGCUUGGCGUGAUGUAUCUGUAUG-3'   (SEQ ID NO: 3629)
                3'-GGGACGAACCGCACUACAUAGACAUAC-5'   (SEQ ID NO: 749)
CKAP5-2482 Target:5'-CCCTGCTTGGCGTGATGTATCTGTATG-3' (SEQ ID NO: 1325)

5'-GUUCUUUGAGGAUGAGAAGCCUGCCCU-3'   (SEQ ID NO: 3630)
                3'-CAAGAAACUCCUACUCUUCGGACGGGA-5'   (SEQ ID NO: 750)
CKAP5-2528 Target:5'-GTTCTTTGAGGATGAGAAGCCTGCCCT-3' (SEQ ID NO: 1326)

5'-UCUUUGAGGAUGAGAAGCCUGCCCUCC-3'   (SEQ ID NO: 3631)
                3'-AGAAACUCCUACUCUUCGGACGGGAGG-5'   (SEQ ID NO: 751)
CKAP5-2530 Target:5'-TCTTTGAGGATGAGAAGCCTGCCCTCC-3' (SEQ ID NO: 1327)

5'-UUUGAGGAUGAGAAGCCUGCCCUCCUA-3'   (SEQ ID NO: 3632)
                3'-AAACUCCUACUCUUCGGACGGGAGGAU-5'   (SEQ ID NO: 752)
CKAP5-2532 Target:5'-TTTGAGGATGAGAAGCCTGCCCTCCTA-3' (SEQ ID NO: 1328)

5'-UGAGGAUGAGAAGCCUGCCCUCCUAUC-3'   (SEQ ID NO: 3633)
                3'-ACUCCUACUCUUCGGACGGGAGGAUAG-5'   (SEQ ID NO: 753)
CKAP5-2534 Target:5'-TGAGGATGAGAAGCCTGCCCTCCTATC-3' (SEQ ID NO: 1329)

5'-AGGAUGAGAAGCCUGCCCUCCUAUCCC-3'   (SEQ ID NO: 3634)
                3'-UCCUACUCUUCGGACGGGAGGAUAGGG-5'   (SEQ ID NO: 754)
CKAP5-2536 Target:5'-AGGATGAGAAGCCTGCCCTCCTATCCC-3' (SEQ ID NO: 1330)

5'-GAUGAGAAGCCUGCCCUCCUAUCCCAG-3'   (SEQ ID NO: 3635)
                3'-CUACUCUUCGGACGGGAGGAUAGGGUC-5'   (SEQ ID NO: 755)
CKAP5-2538 Target:5'-GATGAGAAGCCTGCCCTCCTATCCCAG-3' (SEQ ID NO: 1331)

5'-UGAGAAGCCUGCCCUCCUAUCCCAGAU-3'   (SEQ ID NO: 3636)
                3'-ACUCUUCGGACGGGAGGAUAGGGUCUA-5'   (SEQ ID NO: 756)
CKAP5-2540 Target:5'-TGAGAAGCCTGCCCTCCTATCCCAGAT-3' (SEQ ID NO: 1332)

5'-AGAAGCCUGCCCUCCUAUCCCAGAUAG-3'   (SEQ ID NO: 3637)
                3'-UCUUCGGACGGGAGGAUAGGGUCUAUC-5'   (SEQ ID NO: 757)
CKAP5-2542 Target:5'-AGAAGCCTGCCCTCCTATCCCAGATAG-3' (SEQ ID NO: 1333)

5'-AAGCCUGCCCUCCUAUCCCAGAUAGAU-3'   (SEQ ID NO: 3638)
                3'-UUCGGACGGGAGGAUAGGGUCUAUCUA-5'   (SEQ ID NO: 758)
CKAP5-2544 Target:5'-AAGCCTGCCCTCCTATCCCAGATAGAT-3' (SEQ ID NO: 1334)

5'-GCCUGCCCUCCUAUCCCAGAUAGAUGC-3'   (SEQ ID NO: 3639)
                3'-CGGACGGGAGGAUAGGGUCUAUCUACG-5'   (SEQ ID NO: 759)
CKAP5-2546 Target:5'-GCCTGCCCTCCTATCCCAGATAGATGC-3' (SEQ ID NO: 1335)

5'-CUGCCCUCCUAUCCCAGAUAGAUGCAG-3'   (SEQ ID NO: 3640)
                3'-GACGGGAGGAUAGGGUCUAUCUACGUC-5'   (SEQ ID NO: 760)
CKAP5-2548 Target:5'-CTGCCCTCCTATCCCAGATAGATGCAG-3' (SEQ ID NO: 1336)

5'-GCCCUCCUAUCCCAGAUAGAUGCAGAA-3'   (SEQ ID NO: 3641)
                3'-CGGGAGGAUAGGGUCUAUCUACGUCUU-5'   (SEQ ID NO: 761)
CKAP5-2550 Target:5'-GCCCTCCTATCCCAGATAGATGCAGAA-3' (SEQ ID NO: 1337)

5'-CCUCCUAUCCCAGAUAGAUGCAGAAUU-3'   (SEQ ID NO: 3642)
                3'-GGAGGAUAGGGUCUAUCUACGUCUUAA-5'   (SEQ ID NO: 762)
CKAP5-2552 Target:5'-CCTCCTATCCCAGATAGATGCAGAATT-3' (SEQ ID NO: 1338)
```

TABLE 6-continued

Selected Human Anti-CKAP5 "Blunt/Blunt" DsiRNAs

```
                 5'-UCCUAUCCCAGAUAGAUGCAGAAUUUG-3'  (SEQ ID NO: 3643)
                 3'-AGGAUAGGGUCUAUCUACGUCUUAAAC-5'  (SEQ ID NO: 763)
CKAP5-2554 Target: 5'-TCCTATCCCAGATAGATGCAGAATTTG-3'  (SEQ ID NO: 1339)

5'-CUAUCCCAGAUAGAUGCAGAAUUUGAG-3'  (SEQ ID NO: 3644)
                 3'-GAUAGGGUCUAUCUACGUCUUAAACUC-5'  (SEQ ID NO: 764)
CKAP5-2556 Target: 5'-CTATCCCAGATAGATGCAGAATTTGAG-3'  (SEQ ID NO: 1340)

5'-AUCCCAGAUAGAUGCAGAAUUUGAGAA-3'  (SEQ ID NO: 3645)
                 3'-UAGGGUCUAUCUACGUCUUAAACUCUU-5'  (SEQ ID NO: 765)
CKAP5-2558 Target: 5'-ATCCCAGATAGATGCAGAATTTGAGAA-3'  (SEQ ID NO: 1341)

5'-AGAAGAUGCAGGGACAAAGUCCACCUG-3'  (SEQ ID NO: 3646)
                 3'-UCUUCUACGUCCCUGUUUCAGGUGGAC-5'  (SEQ ID NO: 766)
CKAP5-2581 Target: 5'-AGAAGATGCAGGGACAAAGTCCACCTG-3'  (SEQ ID NO: 1342)

5'-GGUACAGAUGAAGGAGAAGAUGGAGAU-3'  (SEQ ID NO: 3647)
                 3'-CCAUGUCUACUUCCUCUUCUACCUCUA-5'  (SEQ ID NO: 767)
CKAP5-2643 Target: 5'-GGTACAGATGAAGGAGAAGATGGAGAT-3'  (SEQ ID NO: 1343)

5'-UACAGAUGAAGGAGAAGAUGGAGAUGA-3'  (SEQ ID NO: 3648)
                 3'-AUGUCUACUUCCUCUUCUACCUCUACU-5'  (SEQ ID NO: 768)
CKAP5-2645 Target: 5'-TACAGATGAAGGAGAAGATGGAGATGA-3'  (SEQ ID NO: 1344)

5'-CAGAUGAAGGAGAAGAUGGAGAUGAAC-3'  (SEQ ID NO: 3649)
                 3'-GUCUACUUCCUCUUCUACCUCUACUUG-5'  (SEQ ID NO: 769)
CKAP5-2647 Target: 5'-CAGATGAAGGAGAAGATGGAGATGAAC-3'  (SEQ ID NO: 1345)

5'-UCGUUGAUCUUUUGCCGAGGACGGAGA-3'  (SEQ ID NO: 3650)
                 3'-AGCAACUAGAAAACGGCUCCUGCCUCU-5'  (SEQ ID NO: 770)
CKAP5-2695 Target: 5'-TCGTTGATCTTTTGCCGAGGACGGAGA-3'  (SEQ ID NO: 1346)

5'-UAGGAAAGAAGGCCUAGAUGAAGUGGC-3'  (SEQ ID NO: 3651)
                 3'-AUCCUUUCUUCCGGAUCUACUUCACCG-5'  (SEQ ID NO: 771)
CKAP5-2780 Target: 5'-TAGGAAAGAAGGCCTAGATGAAGTGGC-3'  (SEQ ID NO: 1347)

5'-GGAAAGAAGGCCUAGAUGAAGUGGCAG-3'  (SEQ ID NO: 3652)
                 3'-CCUUUCUUCCGGAUCUACUUCACCGUC-5'  (SEQ ID NO: 772)
CKAP5-2782 Target: 5'-GGAAAGAAGGCCTAGATGAAGTGGCAG-3'  (SEQ ID NO: 1348)

5'-AAAGAAGGCCUAGAUGAAGUGGCAGGU-3'  (SEQ ID NO: 3653)
                 3'-UUUCUUCCGGAUCUACUUCACCGUCCA-5'  (SEQ ID NO: 773)
CKAP5-2784 Target: 5'-AAAGAAGGCCTAGATGAAGTGGCAGGT-3'  (SEQ ID NO: 1349)

5'-AGAAGGCCUAGAUGAAGUGGCAGGUAU-3'  (SEQ ID NO: 3654)
                 3'-UCUUCCGGAUCUACUUCACCGUCCAUA-5'  (SEQ ID NO: 774)
CKAP5-2786 Target: 5'-AGAAGGCCTAGATGAAGTGGCAGGTAT-3'  (SEQ ID NO: 1350)

5'-AAGGCCUAGAUGAAGUGGCAGGUAUUA-3'  (SEQ ID NO: 3655)
                 3'-UUCCGGAUCUACUUCACCGUCCAUAAU-5'  (SEQ ID NO: 775)
CKAP5-2788 Target: 5'-AAGGCCTAGATGAAGTGGCAGGTATTA-3'  (SEQ ID NO: 1351)

5'-GGCCUAGAUGAAGUGGCAGGUAUUAUU-3'  (SEQ ID NO: 3656)
                 3'-CCGGAUCUACUUCACCGUCCAUAAUAA-5'  (SEQ ID NO: 776)
CKAP5-2790 Target: 5'-GGCCTAGATGAAGTGGCAGGTATTATT-3'  (SEQ ID NO: 1352)

5'-CCUAGAUGAAGUGGCAGGUAUUAUUAA-3'  (SEQ ID NO: 3657)
                 3'-GGAUCUACUUCACCGUCCAUAAUAAUU-5'  (SEQ ID NO: 777)
CKAP5-2792 Target: 5'-CCTAGATGAAGTGGCAGGTATTATTAA-3'  (SEQ ID NO: 1353)

5'-UAGAUGAAGUGGCAGGUAUUAUUAAUG-3'  (SEQ ID NO: 3658)
                 3'-AUCUACUUCACCGUCCAUAAUAAUUAC-5'  (SEQ ID NO: 778)
CKAP5-2794 Target: 5'-TAGATGAAGTGGCAGGTATTATTAATG-3'  (SEQ ID NO: 1354)

5'-CGAAUAUAGGUGAACUUCCAACUGCCU-3'  (SEQ ID NO: 3659)
                 3'-GCUUAUAUCCACUUGAAGGUUGACGGA-5'  (SEQ ID NO: 779)
CKAP5-2839 Target: 5'-CGAATATAGGTGAACTTCCAACTGCCT-3'  (SEQ ID NO: 1355)

5'-AAUAUAGGUGAACUUCCAACUGCCUUG-3'  (SEQ ID NO: 3660)
                 3'-UUAUAUCCACUUGAAGGUUGACGGAAC-5'  (SEQ ID NO: 780)
CKAP5-2841 Target: 5'-AATATAGGTGAACTTCCAACTGCCTTG-3'  (SEQ ID NO: 1356)

5'-UAUAGGUGAACUUCCAACUGCCUUGAA-3'  (SEQ ID NO: 3661)
                 3'-AUAUCCACUUGAAGGUUGACGGAACUU-5'  (SEQ ID NO: 781)
CKAP5-2843 Target: 5'-TATAGGTGAACTTCCAACTGCCTTGAA-3'  (SEQ ID NO: 1357)
```

TABLE 6-continued

Selected Human Anti-CKAP5 "Blunt/Blunt" DsiRNAs

|  |  |  |
|---|---|---|
|  | 5'-UAGGUGAACUUCCAACUGCCUUGAAGG-3' | (SEQ ID NO: 3662) |
|  | 3'-AUCCACUUGAAGGUUGACGGAACUUCC-5' | (SEQ ID NO: 782) |
| CKAP5-2845 Target: | 5'-TAGGTGAACTTCCAACTGCCTTGAAGG-3' | (SEQ ID NO: 1358) |
|  | 5'-GGUGAACUUCCAACUGCCUUGAAGGGU-3' | (SEQ ID NO: 3663) |
|  | 3'-CCACUUGAAGGUUGACGGAACUUCCCA-5' | (SEQ ID NO: 783) |
| CKAP5-2847 Target: | 5'-GGTGAACTTCCAACTGCCTTGAAGGGT-3' | (SEQ ID NO: 1359) |
|  | 5'-UGAACUUCCAACUGCCUUGAAGGGUCG-3' | (SEQ ID NO: 3664) |
|  | 3'-ACUUGAAGGUUGACGGAACUUCCCAGC-5' | (SEQ ID NO: 784) |
| CKAP5-2849 Target: | 5'-TGAACTTCCAACTGCCTTGAAGGGTCG-3' | (SEQ ID NO: 1360) |
|  | 5'-AACUUCCAACUGCCUUGAAGGGUCGAC-3' | (SEQ ID NO: 3665) |
|  | 3'-UUGAAGGUUGACGGAACUUCCCAGCUG-5' | (SEQ ID NO: 785) |
| CKAP5-2851 Target: | 5'-AACTTCCAACTGCCTTGAAGGGTCGAC-3' | (SEQ ID NO: 1361) |
|  | 5'-CUUCCAACUGCCUUGAAGGGUCGACUC-3' | (SEQ ID NO: 3666) |
|  | 3'-GAAGGUUGACGGAACUUCCCAGCUGAG-5' | (SEQ ID NO: 786) |
| CKAP5-2853 Target: | 5'-CTTCCAACTGCCTTGAAGGGTCGACTC-3' | (SEQ ID NO: 1362) |
|  | 5'-UCCAACUGCCUUGAAGGGUCGACUCAA-3' | (SEQ ID NO: 3667) |
|  | 3'-AGGUUGACGGAACUUCCCAGCUGAGUU-5' | (SEQ ID NO: 787) |
| CKAP5-2855 Target: | 5'-TCCAACTGCCTTGAAGGGTCGACTCAA-3' | (SEQ ID NO: 1363) |
|  | 5'-CAACUGCCUUGAAGGGUCGACUCAAUG-3' | (SEQ ID NO: 3668) |
|  | 3'-GUUGACGGAACUUCCCAGCUGAGUUAC-5' | (SEQ ID NO: 788) |
| CKAP5-2857 Target: | 5'-CAACTGCCTTGAAGGGTCGACTCAATG-3' | (SEQ ID NO: 1364) |
|  | 5'-AACAACUGGCAGUAGCCAUGGGCCCAA-3' | (SEQ ID NO: 3669) |
|  | 3'-UUGUUGACCGUCAUCGGUACCCGGGUU-5' | (SEQ ID NO: 789) |
| CKAP5-2926 Target: | 5'-AACAACTGGCAGTAGCCATGGGCCCAA-3' | (SEQ ID NO: 1365) |
|  | 5'-ACAGCAAGAACAAUGUUCGAGCUGCUG-3' | (SEQ ID NO: 3670) |
|  | 3'-UGUCGUUCUUGUUACAAGCUCGACGAC-5' | (SEQ ID NO: 790) |
| CKAP5-3007 Target: | 5'-ACAGCAAGAACAATGTTCGAGCTGCTG-3' | (SEQ ID NO: 1366) |
|  | 5'-AGCAAGAACAAUGUUCGAGCUGCUGCC-3' | (SEQ ID NO: 3671) |
|  | 3'-UCGUUCUUGUUACAAGCUCGACGACGG-5' | (SEQ ID NO: 791) |
| CKAP5-3009 Target: | 5'-AGCAAGAACAATGTTCGAGCTGCTGCC-3' | (SEQ ID NO: 1367) |
|  | 5'-CAAGAACAAUGUUCGAGCUGCUGCCCU-3' | (SEQ ID NO: 3672) |
|  | 3'-GUUCUUGUUACAAGCUCGACGACGGGA-5' | (SEQ ID NO: 792) |
| CKAP5-3011 Target: | 5'-CAAGAACAATGTTCGAGCTGCTGCCCT-3' | (SEQ ID NO: 1368) |
|  | 5'-AGAACAAUGUUCGAGCUGCUGCCCUAG-3' | (SEQ ID NO: 3673) |
|  | 3'-UCUUGUUACAAGCUCGACGACGGGAUC-5' | (SEQ ID NO: 793) |
| CKAP5-3013 Target: | 5'-AGAACAATGTTCGAGCTGCTGCCCTAG-3' | (SEQ ID NO: 1369) |
|  | 5'-AACAAUGUUCGAGCUGCUGCCCUAGCG-3' | (SEQ ID NO: 3674) |
|  | 3'-UUGUUACAAGCUCGACGACGGGAUCGC-5' | (SEQ ID NO: 794) |
| CKAP5-3015 Target: | 5'-AACAATGTTCGAGCTGCTGCCCTAGCG-3' | (SEQ ID NO: 1370) |
|  | 5'-CAAUGUUCGAGCUGCUGCCCUAGCGAC-3' | (SEQ ID NO: 3675) |
|  | 3'-GUUACAAGCUCGACGACGGGAUCGCUG-5' | (SEQ ID NO: 795) |
| CKAP5-3017 Target: | 5'-CAATGTTCGAGCTGCTGCCCTAGCGAC-3' | (SEQ ID NO: 1371) |
|  | 5'-AUGUUCGAGCUGCUGCCCUAGCGACUG-3' | (SEQ ID NO: 3676) |
|  | 3'-UACAAGCUCGACGACGGGAUCGCUGAC-5' | (SEQ ID NO: 796) |
| CKAP5-3019 Target: | 5'-ATGTTCGAGCTGCTGCCCTAGCGACTG-3' | (SEQ ID NO: 1372) |
|  | 5'-CGACUGUGAAUGCUUGGGCAGAACAGA-3' | (SEQ ID NO: 3677) |
|  | 3'-GCUGACACUUACGAACCCGUCUUGUCU-5' | (SEQ ID NO: 797) |
| CKAP5-3040 Target: | 5'-CGACTGTGAATGCTTGGGCAGAACAGA-3' | (SEQ ID NO: 1373) |
|  | 5'-ACUGUGAAUGCUUGGGCAGAACAGACU-3' | (SEQ ID NO: 3678) |
|  | 3'-UGACACUUACGAACCCGUCUUGUCUGA-5' | (SEQ ID NO: 798) |
| CKAP5-3042 Target: | 5'-ACTGTGAATGCTTGGGCAGAACAGACT-3' | (SEQ ID NO: 1374) |
|  | 5'-UGUGAAUGCUUGGGCAGAACAGACUGG-3' | (SEQ ID NO: 3679) |
|  | 3'-ACACUUACGAACCCGUCUUGUCUGACC-5' | (SEQ ID NO: 799) |
| CKAP5-3044 Target: | 5'-TGTGAATGCTTGGGCAGAACAGACTGG-3' | (SEQ ID NO: 1375) |
|  | 5'-AGGAGAAGAUCUUUCUGAAGAGCUCAA-3' | (SEQ ID NO: 3680) |
|  | 3'-UCCUCUUCUAGAAAGACUUCUCGAGUU-5' | (SEQ ID NO: 800) |
| CKAP5-3089 Target: | 5'-AGGAGAAGATCTTTCTGAAGAGCTCAA-3' | (SEQ ID NO: 1376) |

TABLE 6-continued

Selected Human Anti-CKAP5 "Blunt/Blunt" DsiRNAs

|  |  |  |
|---|---|---|
|  | 5'-GCCUAGAAGAUCGAAAUGGAGAUGUGC-3' | (SEQ ID NO: 3681) |
|  | 3'-CGGAUCUUCUAGCUUUACCUCUACACG-5' | (SEQ ID NO: 801) |
| CKAP5-3229 Target: | 5'-GCCTAGAAGATCGAAATGGAGATGTGC-3' | (SEQ ID NO: 1377) |
|  | 5'-CUAGAAGAUCGAAAUGGAGAUGUGCGA-3' | (SEQ ID NO: 3682) |
|  | 3'-GAUCUUCUAGCUUUACCUCUACACGCU-5' | (SEQ ID NO: 802) |
| CKAP5-3231 Target: | 5'-CTAGAAGATCGAAATGGAGATGTGCGA-3' | (SEQ ID NO: 1378) |
|  | 5'-AGAAGAUCGAAAUGGAGAUGUGCGAAA-3' | (SEQ ID NO: 3683) |
|  | 3'-UCUUCUAGCUUUACCUCUACACGCUUU-5' | (SEQ ID NO: 803) |
| CKAP5-3233 Target: | 5'-AGAAGATCGAAATGGAGATGTGCGAAA-3' | (SEQ ID NO: 1379) |
|  | 5'-CAUGAUGCAUUUAGGAUAUGAAAAAAU-3' | (SEQ ID NO: 3684) |
|  | 3'-GUACUACGUAAAUCCUAUACUUUUUUA-5' | (SEQ ID NO: 804) |
| CKAP5-3287 Target: | 5'-CATGATGCATTTAGGATATGAAAAAAT-3' | (SEQ ID NO: 1380) |
|  | 5'-UGAUGCAUUUAGGAUAUGAAAAAAUGG-3' | (SEQ ID NO: 3685) |
|  | 3'-ACUACGUAAAUCCUAUACUUUUUUACC-5' | (SEQ ID NO: 805) |
| CKAP5-3289 Target: | 5'-TGATGCATTTAGGATATGAAAAAATGG-3' | (SEQ ID NO: 1381) |
|  | 5'-AUGCAUUUAGGAUAUGAAAAAAUGGCC-3' | (SEQ ID NO: 3686) |
|  | 3'-UACGUAAAUCCUAUACUUUUUUACCGG-5' | (SEQ ID NO: 806) |
| CKAP5-3291 Target: | 5'-ATGCATTTAGGATATGAAAAAATGGCC-3' | (SEQ ID NO: 1382) |
|  | 5'-GCAUUUAGGAUAUGAAAAAAUGGCCAA-3' | (SEQ ID NO: 3687) |
|  | 3'-CGUAAAUCCUAUACUUUUUUACCGGUU-5' | (SEQ ID NO: 807) |
| CKAP5-3293 Target: | 5'-GCATTTAGGATATGAAAAAATGGCCAA-3' | (SEQ ID NO: 1383) |
|  | 5'-AUUUAGGAUAUGAAAAAAUGGCCAAGG-3' | (SEQ ID NO: 3688) |
|  | 3'-UAAAUCCUAUACUUUUUUACCGGUUCC-5' | (SEQ ID NO: 808) |
| CKAP5-3295 Target: | 5'-ATTTAGGATATGAAAAAATGGCCAAGG-3' | (SEQ ID NO: 1384) |
|  | 5'-CCAAGGCUACUGGGAAACUAAAGCCAA-3' | (SEQ ID NO: 3689) |
|  | 3'-GGUUCCGAUGACCCUUUGAUUUCGGUU-5' | (SEQ ID NO: 809) |
| CKAP5-3316 Target: | 5'-CCAAGGCTACTGGGAAACTAAAGCCAA-3' | (SEQ ID NO: 1385) |
|  | 5'-AAGGCUACUGGGAAACUAAAGCCAACU-3' | (SEQ ID NO: 3690) |
|  | 3'-UUCCGAUGACCCUUUGAUUUCGGUUGA-5' | (SEQ ID NO: 810) |
| CKAP5-3318 Target: | 5'-AAGGCTACTGGGAAACTAAAGCCAACT-3' | (SEQ ID NO: 1386) |
|  | 5'-GGCUACUGGGAAACUAAAGCCAACUUC-3' | (SEQ ID NO: 3691) |
|  | 3'-CCGAUGACCCUUUGAUUUCGGUUGAAG-5' | (SEQ ID NO: 811) |
| CKAP5-3320 Target: | 5'-GGCTACTGGGAAACTAAAGCCAACTTC-3' | (SEQ ID NO: 1387) |
|  | 5'-CUACUGGGAAACUAAAGCCAACUUCUA-3' | (SEQ ID NO: 3692) |
|  | 3'-GAUGACCCUUUGAUUUCGGUUGAAGAU-5' | (SEQ ID NO: 812) |
| CKAP5-3322 Target: | 5'-CTACTGGGAAACTAAAGCCAACTTCTA-3' | (SEQ ID NO: 1388) |
|  | 5'-ACUGGGAAACUAAAGCCAACUUCUAAA-3' | (SEQ ID NO: 3693) |
|  | 3'-UGACCCUUUGAUUUCGGUUGAAGAUUU-5' | (SEQ ID NO: 813) |
| CKAP5-3324 Target: | 5'-ACTGGGAAACTAAAGCCAACTTCTAAA-3' | (SEQ ID NO: 1389) |
|  | 5'-UGGGAAACUAAAGCCAACUUCUAAAGA-3' | (SEQ ID NO: 3694) |
|  | 3'-ACCCUUUGAUUUCGGUUGAAGAUUUCU-5' | (SEQ ID NO: 814) |
| CKAP5-3326 Target: | 5'-TGGGAAACTAAAGCCAACTTCTAAAGA-3' | (SEQ ID NO: 1390) |
|  | 5'-GGAAACUAAAGCCAACUUCUAAAGAUC-3' | (SEQ ID NO: 3695) |
|  | 3'-CCUUUGAUUUCGGUUGAAGAUUUCUAG-5' | (SEQ ID NO: 815) |
| CKAP5-3328 Target: | 5'-GGAAACTAAAGCCAACTTCTAAAGATC-3' | (SEQ ID NO: 1391) |
|  | 5'-AAACUAAAGCCAACUUCUAAAGAUCAG-3' | (SEQ ID NO: 3696) |
|  | 3'-UUUGAUUUCGGUUGAAGAUUUCUAGUC-5' | (SEQ ID NO: 816) |
| CKAP5-3330 Target: | 5'-AAACTAAAGCCAACTTCTAAAGATCAG-3' | (SEQ ID NO: 1392) |
|  | 5'-ACUAAAGCCAACUUCUAAAGAUCAGGU-3' | (SEQ ID NO: 3697) |
|  | 3'-UGAUUUCGGUUGAAGAUUUCUAGUCCA-5' | (SEQ ID NO: 817) |
| CKAP5-3332 Target: | 5'-ACTAAAGCCAACTTCTAAAGATCAGGT-3' | (SEQ ID NO: 1393) |
|  | 5'-UAAAGCCAACUUCUAAAGAUCAGGUAU-3' | (SEQ ID NO: 3698) |
|  | 3'-AUUUCGGUUGAAGAUUUCUAGUCCAUA-5' | (SEQ ID NO: 818) |
| CKAP5-3334 Target: | 5'-TAAAGCCAACTTCTAAAGATCAGGTAT-3' | (SEQ ID NO: 1394) |
|  | 5'-GGCCUAUUUUUAUUGUUGUUCCAAAUG-3' | (SEQ ID NO: 3699) |
|  | 3'-CCGGAUAAAAAUAACAACAAGGUUUAC-5' | (SEQ ID NO: 819) |
| CKAP5-3625 Target: | 5'-GGCCTATTTTTATTGTTGTTCCAAATG-3' | (SEQ ID NO: 1395) |

TABLE 6-continued

Selected Human Anti-CKAP5 "Blunt/Blunt" DsiRNAs

|  |  |  |
|---|---|---|
|  | 5'-CCUAUUUUUAUUGUUGUUCCAAAUGGA-3' | (SEQ ID NO: 3700) |
|  | 3'-GGAUAAAAAUAACAACAAGGUUUACCU-5' | (SEQ ID NO: 820) |
| CKAP5-3627 Target: | 5'-CCTATTTTTATTGTTGTTCCAAATGGA-3' | (SEQ ID NO: 1396) |
|  | 5'-UAUUUUUAUUGUUGUUCCAAAUGGAAA-3' | (SEQ ID NO: 3701) |
|  | 3'-AUAAAAAUAACAACAAGGUUUACCUUU-5' | (SEQ ID NO: 821) |
| CKAP5-3629 Target: | 5'-TATTTTTATTGTTGTTCCAAATGGAAA-3' | (SEQ ID NO: 1397) |
|  | 5'-UUUUUAUUGUUGUUCCAAAUGGAAAG-3' | (SEQ ID NO: 3702) |
|  | 3'-AAAAAUAACAACAAGGUUUACCUUUUC-5' | (SEQ ID NO: 822) |
| CKAP5-3631 Target: | 5'-TTTTTATTGTTGTTCCAAATGGAAAAG-3' | (SEQ ID NO: 1398) |
|  | 5'-UUUAUUGUUGUUCCAAAUGGAAAAGAG-3' | (SEQ ID NO: 3703) |
|  | 3'-AAAUAACAACAAGGUUUACCUUUUCUC-5' | (SEQ ID NO: 823) |
| CKAP5-3633 Target: | 5'-TTTATTGTTGTTCCAAATGGAAAAGAG-3' | (SEQ ID NO: 1399) |
|  | 5'-UAUUGUUGUUCCAAAUGGAAAAGAGCA-3' | (SEQ ID NO: 3704) |
|  | 3'-AUAACAACAAGGUUUACCUUUUCUCGU-5' | (SEQ ID NO: 824) |
| CKAP5-3635 Target: | 5'-TATTGTTGTTCCAAATGGAAAAGAGCA-3' | (SEQ ID NO: 1400) |
|  | 5'-GAAGGUGCUAAAGUGGAAUUUUACUAC-3' | (SEQ ID NO: 3705) |
|  | 3'-CUUCCACGAUUUCACCUUAAAAUGAUG-5' | (SEQ ID NO: 825) |
| CKAP5-3686 Target: | 5'-GAAGGTGCTAAAGTGGAATTTTACTAC-3' | (SEQ ID NO: 1401) |
|  | 5'-AGGUGCUAAAGUGGAAUUUUACUACCC-3' | (SEQ ID NO: 3706) |
|  | 3'-UCCACGAUUUCACCUUAAAAUGAUGGG-5' | (SEQ ID NO: 826) |
| CKAP5-3688 Target: | 5'-AGGTGCTAAAGTGGAATTTTACTACCC-3' | (SEQ ID NO: 1402) |
|  | 5'-AUAUCAUCUUACUGAGAAUGAAGCAUC-3' | (SEQ ID NO: 3707) |
|  | 3'-UAUAGUAGAAUGACUCUUACUUCGUAG-5' | (SEQ ID NO: 827) |
| CKAP5-3989 Target: | 5'-ATATCATCTTACTGAGAATGAAGCATC-3' | (SEQ ID NO: 1403) |
|  | 5'-AUCAUCUUACUGAGAAUGAAGCAUCUU-3' | (SEQ ID NO: 3708) |
|  | 3'-UAGUAGAAUGACUCUUACUUCGUAGAA-5' | (SEQ ID NO: 828) |
| CKAP5-3991 Target: | 5'-ATCATCTTACTGAGAATGAAGCATCTT-3' | (SEQ ID NO: 1404) |
|  | 5'-CAUCUUACUGAGAAUGAAGCAUCUUCC-3' | (SEQ ID NO: 3709) |
|  | 3'-GUAGAAUGACUCUUACUUCGUAGAAGG-5' | (SEQ ID NO: 829) |
| CKAP5-3993 Target: | 5'-CATCTTACTGAGAATGAAGCATCTTCC-3' | (SEQ ID NO: 1405) |
|  | 5'-UCUUACUGAGAAUGAAGCAUCUUCCUU-3' | (SEQ ID NO: 3710) |
|  | 3'-AGAAUGACUCUUACUUCGUAGAAGGAA-5' | (SEQ ID NO: 830) |
| CKAP5-3995 Target: | 5'-TCTTACTGAGAATGAAGCATCTTCCTT-3' | (SEQ ID NO: 1406) |
|  | 5'-GUCAAGGUUGGAGAACCAAAGGAUGUC-3' | (SEQ ID NO: 3711) |
|  | 3'-CAGUUCCAACCUCUUGGUUUCCUACAG-5' | (SEQ ID NO: 831) |
| CKAP5-4038 Target: | 5'-GTCAAGGTTGGAGAACCAAAGGATGTC-3' | (SEQ ID NO: 1407) |
|  | 5'-CAAGGUUGGAGAACCAAAGGAUGUCAU-3' | (SEQ ID NO: 3712) |
|  | 3'-GUUCCAACCUCUUGGUUUCCUACAGUA-5' | (SEQ ID NO: 832) |
| CKAP5-4040 Target: | 5'-CAAGGTTGGAGAACCAAAGGATGTCAT-3' | (SEQ ID NO: 1408) |
|  | 5'-AGGUUGGAGAACCAAAGGAUGUCAUUC-3' | (SEQ ID NO: 3713) |
|  | 3'-UCCAACCUCUUGGUUUCCUACAGUAAG-5' | (SEQ ID NO: 833) |
| CKAP5-4042 Target: | 5'-AGGTTGGAGAACCAAAGGATGTCATTC-3' | (SEQ ID NO: 1409) |
|  | 5'-GUUGGAGAACCAAAGGAUGUCAUUCGU-3' | (SEQ ID NO: 3714) |
|  | 3'-CAACCUCUUGGUUUCCUACAGUAAGCA-5' | (SEQ ID NO: 834) |
| CKAP5-4044 Target: | 5'-GTTGGAGAACCAAAGGATGTCATTCGT-3' | (SEQ ID NO: 1410) |
|  | 5'-UGGAGAACCAAAGGAUGUCAUUCGUAA-3' | (SEQ ID NO: 3715) |
|  | 3'-ACCUCUUGGUUUCCUACAGUAAGCAUU-5' | (SEQ ID NO: 835) |
| CKAP5-4046 Target: | 5'-TGGAGAACCAAAGGATGTCATTCGTAA-3' | (SEQ ID NO: 1411) |
|  | 5'-GAGAACCAAAGGAUGUCAUUCGUAAAG-3' | (SEQ ID NO: 3716) |
|  | 3'-CUCUUGGUUUCCUACAGUAAGCAUUUC-5' | (SEQ ID NO: 836) |
| CKAP5-4048 Target: | 5'-GAGAACCAAAGGATGTCATTCGTAAAG-3' | (SEQ ID NO: 1412) |
|  | 5'-GAACCAAAGGAUGUCAUUCGUAAAGAU-3' | (SEQ ID NO: 3717) |
|  | 3'-CUUGGUUUCCUACAGUAAGCAUUUCUA-5' | (SEQ ID NO: 837) |
| CKAP5-4050 Target: | 5'-GAACCAAAGGATGTCATTCGTAAAGAT-3' | (SEQ ID NO: 1413) |
|  | 5'-ACCAAAGGAUGUCAUUCGUAAAGAUGU-3' | (SEQ ID NO: 3718) |
|  | 3'-UGGUUUCCUACAGUAAGCAUUUCUACA-5' | (SEQ ID NO: 838) |
| CKAP5-4052 Target: | 5'-ACCAAAGGATGTCATTCGTAAAGATGT-3' | (SEQ ID NO: 1414) |

TABLE 6-continued

Selected Human Anti-CKAP5 "Blunt/Blunt" DsiRNAs

```
                5'-CAAAGGAUGUCAUUCGUAAAGAUGUUC-3'  (SEQ ID NO: 3719)
                3'-GUUUCCUACAGUAAGCAUUUCUACAAG-5'  (SEQ ID NO: 839)
CKAP5-4054 Target: 5'-CAAAGGATGTCATTCGTAAAGATGTTC-3' (SEQ ID NO: 1415)

5'-AAGGAUGUCAUUCGUAAAGAUGUUCGU-3'  (SEQ ID NO: 3720)
                3'-UUCCUACAGUAAGCAUUUCUACAAGCA-5'  (SEQ ID NO: 840)
CKAP5-4056 Target: 5'-AAGGATGTCATTCGTAAAGATGTTCGT-3' (SEQ ID NO: 1416)

5'-GGAUGUCAUUCGUAAAGAUGUUCGUGC-3'  (SEQ ID NO: 3721)
                3'-CCUACAGUAAGCAUUUCUACAAGCACG-5'  (SEQ ID NO: 841)
CKAP5-4058 Target: 5'-GGATGTCATTCGTAAAGATGTTCGTGC-3' (SEQ ID NO: 1417)

5'-CAUCCUGAACCGGAUGUGCCUUGUCUA-3'  (SEQ ID NO: 3722)
                3'-GUAGGACUUGGCCUACACGGAACAGAU-5'  (SEQ ID NO: 842)
CKAP5-4085 Target: 5'-CATCCTGAACCGGATGTGCCTTGTCTA-3' (SEQ ID NO: 1418)

5'-UCCUGAACCGGAUGUGCCUUGUCUACC-3'  (SEQ ID NO: 3723)
                3'-AGGACUUGGCCUACACGGAACAGAUGG-5'  (SEQ ID NO: 843)
CKAP5-4087 Target: 5'-TCCTGAACCGGATGTGCCTTGTCTACC-3' (SEQ ID NO: 1419)

5'-CUGAACCGGAUGUGCCUUGUCUACCCA-3'  (SEQ ID NO: 3724)
                3'-GACUUGGCCUACACGGAACAGAUGGGU-5'  (SEQ ID NO: 844)
CKAP5-4089 Target: 5'-CTGAACCGGATGTGCCTTGTCTACCCA-3' (SEQ ID NO: 1420)

5'-GAACCGGAUGUGCCUUGUCUACCCAGC-3'  (SEQ ID NO: 3725)
                3'-CUUGGCCUACACGGAACAGAUGGGUCG-5'  (SEQ ID NO: 845)
CKAP5-4091 Target: 5'-GAACCGGATGTGCCTTGTCTACCCAGC-3' (SEQ ID NO: 1421)

5'-ACCGGAUGUGCCUUGUCUACCCAGCUA-3'  (SEQ ID NO: 3726)
                3'-UGGCCUACACGGAACAGAUGGGUCGAU-5'  (SEQ ID NO: 846)
CKAP5-4093 Target: 5'-ACCGGATGTGCCTTGTCTACCCAGCTA-3' (SEQ ID NO: 1422)

5'-CGGAUGUGCCUUGUCUACCCAGCUAGC-3'  (SEQ ID NO: 3727)
                3'-GCCUACACGGAACAGAUGGGUCGAUCG-5'  (SEQ ID NO: 847)
CKAP5-4095 Target: 5'-CGGATGTGCCTTGTCTACCCAGCTAGC-3' (SEQ ID NO: 1423)

5'-GAUGUGCCUUGUCUACCCAGCUAGCAA-3'  (SEQ ID NO: 3728)
                3'-CUACACGGAACAGAUGGGUCGAUCGUU-5'  (SEQ ID NO: 848)
CKAP5-4097 Target: 5'-GATGTGCCTTGTCTACCCAGCTAGCAA-3' (SEQ ID NO: 1424)

5'-AUCCAAAAACUCUAAGCAGAGAGCAGA-3'  (SEQ ID NO: 3729)
                3'-UAGGUUUUUGAGAUUCGUCUCUCGUCU-5'  (SEQ ID NO: 849)
CKAP5-4154 Target: 5'-ATCCAAAAACTCTAAGCAGAGAGCAGA-3' (SEQ ID NO: 1425)

5'-CCAAAAACUCUAAGCAGAGAGCAGAGU-3'  (SEQ ID NO: 3730)
                3'-GGUUUUUGAGAUUCGUCUCUCGUCUCA-5'  (SEQ ID NO: 850)
CKAP5-4156 Target: 5'-CCAAAAACTCTAAGCAGAGAGCAGAGT-3' (SEQ ID NO: 1426)

5'-AAAAACUCUAAGCAGAGAGCAGAGUGC-3'  (SEQ ID NO: 3731)
                3'-UUUUUGAGAUUCGUCUCUCGUCUCACG-5'  (SEQ ID NO: 851)
CKAP5-4158 Target: 5'-AAAAACTCTAAGCAGAGAGCAGAGTGC-3' (SEQ ID NO: 1427)

5'-AAACUCUAAGCAGAGAGCAGAGUGCCU-3'  (SEQ ID NO: 3732)
                3'-UUUGAGAUUCGUCUCUCGUCUCACGGA-5'  (SEQ ID NO: 852)
CKAP5-4160 Target: 5'-AAACTCTAAGCAGAGAGCAGAGTGCCT-3' (SEQ ID NO: 1428)

5'-ACUCUAAGCAGAGAGCAGAGUGCCUGG-3'  (SEQ ID NO: 3733)
                3'-UGAGAUUCGUCUCUCGUCUCACGGACC-5'  (SEQ ID NO: 853)
CKAP5-4162 Target: 5'-ACTCTAAGCAGAGAGCAGAGTGCCTGG-3' (SEQ ID NO: 1429)

5'-UCUAAGCAGAGAGCAGAGUGCCUGGAA-3'  (SEQ ID NO: 3734)
                3'-AGAUUCGUCUCUCGUCUCACGGACCUU-5'  (SEQ ID NO: 854)
CKAP5-4164 Target: 5'-TCTAAGCAGAGAGCAGAGTGCCTGGAA-3' (SEQ ID NO: 1430)

5'-UAAGCAGAGAGCAGAGUGCCUGGAAGA-3'  (SEQ ID NO: 3735)
                3'-AUUCGUCUCUCGUCUCACGGACCUUCU-5'  (SEQ ID NO: 855)
CKAP5-4166 Target: 5'-TAAGCAGAGAGCAGAGTGCCTGGAAGA-3' (SEQ ID NO: 1431)

5'-AGCAGAGAGCAGAGUGCCUGGAAGAGC-3'  (SEQ ID NO: 3736)
                3'-UCGUCUCUCGUCUCACGGACCUUCUCG-5'  (SEQ ID NO: 856)
CKAP5-4168 Target: 5'-AGCAGAGAGCAGAGTGCCTGGAAGAGC-3' (SEQ ID NO: 1432)

5'-CAGAGAGCAGAGUGCCUGGAAGAGCUG-3'  (SEQ ID NO: 3737)
                3'-GUCUCUCGUCUCACGGACCUUCUCGAC-5'  (SEQ ID NO: 857)
CKAP5-4170 Target: 5'-CAGAGAGCAGAGTGCCTGGAAGAGCTG-3' (SEQ ID NO: 1433)
```

TABLE 6-continued

Selected Human Anti-CKAP5 "Blunt/Blunt" DsiRNAs

|  | | |
|---|---|---|
| | 5'-GAGAGCAGAGUGCCUGGAAGAGCUGGG-3' | (SEQ ID NO: 3738) |
| | 3'-CUCUCGUCUCACGGACCUUCUCGACCC-5' | (SEQ ID NO: 858) |
| CKAP5-4172 Target: | 5'-GAGAGCAGAGTGCCTGGAAGAGCTGGG-3' | (SEQ ID NO: 1434) |
| | 5'-GAGCAGAGUGCCUGGAAGAGCUGGGAU-3' | (SEQ ID NO: 3739) |
| | 3'-CUCGUCUCACGGACCUUCUCGACCCUA-5' | (SEQ ID NO: 859) |
| CKAP5-4174 Target: | 5'-GAGCAGAGTGCCTGGAAGAGCTGGGAT-3' | (SEQ ID NO: 1435) |
| | 5'-CCCAGGAAAAGCCUUAAAGGAAAUAGC-3' | (SEQ ID NO: 3740) |
| | 3'-GGGUCCUUUUCGGAAUUUCCUUUAUCG-5' | (SEQ ID NO: 860) |
| CKAP5-4241 Target: | 5'-CCCAGGAAAAGCCTTAAAGGAAATAGC-3' | (SEQ ID NO: 1436) |
| | 5'-GGAUCAGGUGUUCAAACUGAUUGGAAA-3' | (SEQ ID NO: 3741) |
| | 3'-CCUAGUCCACAAGUUUGACUAACCUUU-5' | (SEQ ID NO: 861) |
| CKAP5-4346 Target: | 5'-GGATCAGGTGTTCAAACTGATTGGAAA-3' | (SEQ ID NO: 1437) |
| | 5'-AUCAGGUGUUCAAACUGAUUGGAAAUC-3' | (SEQ ID NO: 3742) |
| | 3'-UAGUCCACAAGUUUGACUAACCUUUAG-5' | (SEQ ID NO: 862) |
| CKAP5-4348 Target: | 5'-ATCAGGTGTTCAAACTGATTGGAAATC-3' | (SEQ ID NO: 1438) |
| | 5'-CAGGUGUUCAAACUGAUUGGAAAUCUU-3' | (SEQ ID NO: 3743) |
| | 3'-GUCCACAAGUUUGACUAACCUUUAGAA-5' | (SEQ ID NO: 863) |
| CKAP5-4350 Target: | 5'-CAGGTGTTCAAACTGATTGGAAATCTT-3' | (SEQ ID NO: 1439) |
| | 5'-GGUGUUCAAACUGAUUGGAAAUCUUUC-3' | (SEQ ID NO: 3744) |
| | 3'-CCACAAGUUUGACUAACCUUUAGAAAG-5' | (SEQ ID NO: 864) |
| CKAP5-4352 Target: | 5'-GGTGTTCAAACTGATTGGAAATCTTTC-3' | (SEQ ID NO: 1440) |
| | 5'-UGUUCAAACUGAUUGGAAAUCUUUCUG-3' | (SEQ ID NO: 3745) |
| | 3'-ACAAGUUUGACUAACCUUUAGAAAGAC-5' | (SEQ ID NO: 865) |
| CKAP5-4354 Target: | 5'-TGTTCAAACTGATTGGAAATCTTTCTG-3' | (SEQ ID NO: 1441) |
| | 5'-UUCAAACUGAUUGGAAAUCUUUCUGAA-3' | (SEQ ID NO: 3746) |
| | 3'-AAGUUUGACUAACCUUUAGAAAGACUU-5' | (SEQ ID NO: 866) |
| CKAP5-4356 Target: | 5'-TTCAAACTGATTGGAAATCTTTCTGAA-3' | (SEQ ID NO: 1442) |
| | 5'-CAAACUGAUUGGAAAUCUUUCUGAAAA-3' | (SEQ ID NO: 3747) |
| | 3'-GUUUGACUAACCUUUAGAAAGACUUUU-5' | (SEQ ID NO: 867) |
| CKAP5-4358 Target: | 5'-CAAACTGATTGGAAATCTTTCTGAAAA-3' | (SEQ ID NO: 1443) |
| | 5'-AACUGAUUGGAAAUCUUUCUGAAAAGG-3' | (SEQ ID NO: 3748) |
| | 3'-UUGACUAACCUUUAGAAAGACUUUUCC-5' | (SEQ ID NO: 868) |
| CKAP5-4360 Target: | 5'-AACTGATTGGAAATCTTTCTGAAAAGG-3' | (SEQ ID NO: 1444) |
| | 5'-UUAAGCGGUCAGCAAAGAGACCCUCUG-3' | (SEQ ID NO: 3749) |
| | 3'-AAUUCGCCAGUCGUUUCUCUGGGAGAC-5' | (SEQ ID NO: 869) |
| CKAP5-4411 Target: | 5'-TTAAGCGGTCAGCAAAGAGACCCTCTG-3' | (SEQ ID NO: 1445) |
| | 5'-AAGCGGUCAGCAAAGAGACCCUCUGCU-3' | (SEQ ID NO: 3750) |
| | 3'-UUCGCCAGUCGUUUCUCUGGGAGACGA-5' | (SEQ ID NO: 870) |
| CKAP5-4413 Target: | 5'-AAGCGGTCAGCAAAGAGACCCTCTGCT-3' | (SEQ ID NO: 1446) |
| | 5'-GCGGUCAGCAAAGAGACCCUCUGCUGC-3' | (SEQ ID NO: 3751) |
| | 3'-CGCCAGUCGUUUCUCUGGGAGACGACG-5' | (SEQ ID NO: 871) |
| CKAP5-4415 Target: | 5'-GCGGTCAGCAAAGAGACCCTCTGCTGC-3' | (SEQ ID NO: 1447) |
| | 5'-GGUCAGCAAAGAGACCCUCUGCUGCAC-3' | (SEQ ID NO: 3752) |
| | 3'-CCAGUCGUUUCUCUGGGAGACGACGUG-5' | (SEQ ID NO: 872) |
| CKAP5-4417 Target: | 5'-GGTCAGCAAAGAGACCCTCTGCTGCAC-3' | (SEQ ID NO: 1448) |
| | 5'-UCAGCAAAGAGACCCUCUGCUGCACCA-3' | (SEQ ID NO: 3753) |
| | 3'-AGUCGUUUCUCUGGGAGACGACGUGGU-5' | (SEQ ID NO: 873) |
| CKAP5-4419 Target: | 5'-TCAGCAAAGAGACCCTCTGCTGCACCA-3' | (SEQ ID NO: 1449) |
| | 5'-AGCAAAGAGACCCUCUGCUGCACCAAU-3' | (SEQ ID NO: 3754) |
| | 3'-UCGUUUCUCUGGGAGACGACGUGGUUA-5' | (SEQ ID NO: 874) |
| CKAP5-4421 Target: | 5'-AGCAAAGAGACCCTCTGCTGCACCAAT-3' | (SEQ ID NO: 1450) |
| | 5'-CAAAGAGACCCUCUGCUGCACCAAUAA-3' | (SEQ ID NO: 3755) |
| | 3'-GUUUCUCUGGGAGACGACGUGGUUAUU-5' | (SEQ ID NO: 875) |
| CKAP5-4423 Target: | 5'-CAAAGAGACCCTCTGCTGCACCAATAA-3' | (SEQ ID NO: 1451) |
| | 5'-GUUACGCAAGGGACCAGCUGAGGACAU-3' | (SEQ ID NO: 3756) |
| | 3'-CAAUGCGUUCCCUGGUCGACUCCUGUA-5' | (SEQ ID NO: 876) |
| CKAP5-4505 Target: | 5'-GTTACGCAAGGGACCAGCTGAGGACAT-3' | (SEQ ID NO: 1452) |

TABLE 6-continued

Selected Human Anti-CKAP5 "Blunt/Blunt" DsiRNAs

```
                  5'-UACGCAAGGGACCAGCUGAGGACAUGU-3'   (SEQ ID NO: 3757)
                  3'-AUGCGUUCCCUGGUCGACUCCUGUACA-5'   (SEQ ID NO:  877)
CKAP5-4507 Target:5'-TACGCAAGGGACCAGCTGAGGACATGT-3'   (SEQ ID NO: 1453)

5'-UCCGCCGAGAAUUCCAGCUGGAUCUAG-3'   (SEQ ID NO: 3758)
                  3'-AGGCGGCUCUUAAGGUCGACCUAGAUC-5'   (SEQ ID NO:  878)
CKAP5-4591 Target:5'-TCCGCCGAGAATTCCAGCTGGATCTAG-3'   (SEQ ID NO: 1454)

5'-CGCCGAGAAUUCCAGCUGGAUCUAGAU-3'   (SEQ ID NO: 3759)
                  3'-GCGGCUCUUAAGGUCGACCUAGAUCUA-5'   (SEQ ID NO:  879)
CKAP5-4593 Target:5'-CGCCGAGAATTCCAGCTGGATCTAGAT-3'   (SEQ ID NO: 1455)

5'-CAAGAUCCGGGCUGUUUCUCCACACUU-3'   (SEQ ID NO: 3760)
                  3'-GUUCUAGGCCCGACAAAGAGGUGUGAA-5'   (SEQ ID NO:  880)
CKAP5-4718 Target:5'-CAAGATCCGGGCTGTTTCTCCACACTT-3'   (SEQ ID NO: 1456)

5'-AGAUCCGGGCUGUUUCUCCACACUUCG-3'   (SEQ ID NO: 3761)
                  3'-UCUAGGCCCGACAAAGAGGUGUGAAGC-5'   (SEQ ID NO:  881)
CKAP5-4720 Target:5'-AGATCCGGGCTGTTTCTCCACACTTCG-3'   (SEQ ID NO: 1457)

5'-UCGAUGACAUGCACAGUAAUACAGCAU-3'   (SEQ ID NO: 3762)
                  3'-AGCUACUGUACGUGUCAUUAUGUCGUA-5'   (SEQ ID NO:  882)
CKAP5-4744 Target:5'-TCGATGACATGCACAGTAATACAGCAT-3'   (SEQ ID NO: 1458)

5'-GAUGACAUGCACAGUAAUACAGCAUCC-3'   (SEQ ID NO: 3763)
                  3'-CUACUGUACGUGUCAUUAUGUCGUAGG-5'   (SEQ ID NO:  883)
CKAP5-4746 Target:5'-GATGACATGCACAGTAATACAGCATCC-3'   (SEQ ID NO: 1459)

5'-UGACAUGCACAGUAAUACAGCAUCCAC-3'   (SEQ ID NO: 3764)
                  3'-ACUGUACGUGUCAUUAUGUCGUAGGUG-5'   (SEQ ID NO:  884)
CKAP5-4748 Target:5'-TGACATGCACAGTAATACAGCATCCAC-3'   (SEQ ID NO: 1460)

5'-ACAUGCACAGUAAUACAGCAUCCACAA-3'   (SEQ ID NO: 3765)
                  3'-UGUACGUGUCAUUAUGUCGUAGGUGUU-5'   (SEQ ID NO:  885)
CKAP5-4750 Target:5'-ACATGCACAGTAATACAGCATCCACAA-3'   (SEQ ID NO: 1461)

5'-AUGCACAGUAAUACAGCAUCCACAAUC-3'   (SEQ ID NO: 3766)
                  3'-UACGUGUCAUUAUGUCGUAGGUGUUAG-5'   (SEQ ID NO:  886)
CKAP5-4752 Target:5'-ATGCACAGTAATACAGCATCCACAATC-3'   (SEQ ID NO: 1462)

5'-GCACAGUAAUACAGCAUCCACAAUCAA-3'   (SEQ ID NO: 3767)
                  3'-CGUGUCAUUAUGUCGUAGGUGUUAGUU-5'   (SEQ ID NO:  887)
CKAP5-4754 Target:5'-GCACAGTAATACAGCATCCACAATCAA-3'   (SEQ ID NO: 1463)

5'-ACAGUAAUACAGCAUCCACAAUCAAUU-3'   (SEQ ID NO: 3768)
                  3'-UGUCAUUAUGUCGUAGGUGUUAGUUAA-5'   (SEQ ID NO:  888)
CKAP5-4756 Target:5'-ACAGTAATACAGCATCCACAATCAATT-3'   (SEQ ID NO: 1464)

5'-AGUAAUACAGCAUCCACAAUCAAUUUC-3'   (SEQ ID NO: 3769)
                  3'-UCAUUAUGUCGUAGGUGUUAGUUAAAG-5'   (SEQ ID NO:  889)
CKAP5-4758 Target:5'-AGTAATACAGCATCCACAATCAATTTC-3'   (SEQ ID NO: 1465)

5'-UAAUACAGCAUCCACAAUCAAUUUCAU-3'   (SEQ ID NO: 3770)
                  3'-AUUAUGUCGUAGGUGUUAGUUAAAGUA-5'   (SEQ ID NO:  890)
CKAP5-4760 Target:5'-TAATACAGCATCCACAATCAATTTCAT-3'   (SEQ ID NO: 1466)

5'-AUACAGCAUCCACAAUCAAUUUCAUUA-3'   (SEQ ID NO: 3771)
                  3'-UAUGUCGUAGGUGUUAGUUAAAGUAAU-5'   (SEQ ID NO:  891)
CKAP5-4762 Target:5'-ATACAGCATCCACAATCAATTTCATTA-3'   (SEQ ID NO: 1467)

5'-ACAGCAUCCACAAUCAAUUUCAUUAUC-3'   (SEQ ID NO: 3772)
                  3'-UGUCGUAGGUGUUAGUUAAAGUAAUAG-5'   (SEQ ID NO:  892)
CKAP5-4764 Target:5'-ACAGCATCCACAATCAATTTCATTATC-3'   (SEQ ID NO: 1468)

5'-AGCAUCCACAAUCAAUUUCAUUAUCUC-3'   (SEQ ID NO: 3773)
                  3'-UCGUAGGUGUUAGUUAAAGUAAUAGAG-5'   (SEQ ID NO:  893)
CKAP5-4766 Target:5'-AGCATCCACAATCAATTTCATTATCTC-3'   (SEQ ID NO: 1469)

5'-CAUCCACAAUCAAUUUCAUUAUCUCCC-3'   (SEQ ID NO: 3774)
                  3'-GUAGGUGUUAGUUAAAGUAAUAGAGGG-5'   (SEQ ID NO:  894)
CKAP5-4768 Target:5'-CATCCACAATCAATTTCATTATCTCCC-3'   (SEQ ID NO: 1470)

5'-UCCACAAUCAAUUUCAUUAUCUCCCAA-3'   (SEQ ID NO: 3775)
                  3'-AGGUGUUAGUUAAAGUAAUAGAGGGUU-5'   (SEQ ID NO:  895)
CKAP5-4770 Target:5'-TCCACAATCAATTTCATTATCTCCCAA-3'   (SEQ ID NO: 1471)
```

TABLE 6-continued

Selected Human Anti-CKAP5 "Blunt/Blunt" DsiRNAs

|  |  |  |
|---|---|---|
|  | 5'-CACAAUCAAUUUCAUUAUCUCCCAAGU-3' | (SEQ ID NO: 3776) |
|  | 3'-GUGUUAGUUAAAGUAAUAGAGGGUUCA-5' | (SEQ ID NO: 896) |
| CKAP5-4772 Target: | 5'-CACAATCAATTTCATTATCTCCCAAGT-3' | (SEQ ID NO: 1472) |
|  | 5'-CAAUCAAUUUCAUUAUCUCCCAAGUAG-3' | (SEQ ID NO: 3777) |
|  | 3'-GUUAGUUAAAGUAAUAGAGGGUUCAUC-5' | (SEQ ID NO: 897) |
| CKAP5-4774 Target: | 5'-CAATCAATTTCATTATCTCCCAAGTAG-3' | (SEQ ID NO: 1473) |
|  | 5'-AUCAAUUUCAUUAUCUCCCAAGUAGCC-3' | (SEQ ID NO: 3778) |
|  | 3'-UAGUUAAAGUAAUAGAGGGUUCAUCGG-5' | (SEQ ID NO: 898) |
| CKAP5-4776 Target: | 5'-ATCAATTTCATTATCTCCCAAGTAGCC-3' | (SEQ ID NO: 1474) |
|  | 5'-CAAUUUCAUUAUCUCCCAAGUAGCCAG-3' | (SEQ ID NO: 3779) |
|  | 3'-GUUAAAGUAAUAGAGGGUUCAUCGGUC-5' | (SEQ ID NO: 899) |
| CKAP5-4778 Target: | 5'-CAATTTCATTATCTCCCAAGTAGCCAG-3' | (SEQ ID NO: 1475) |
|  | 5'-AUUUCAUUAUCUCCCAAGUAGCCAGUG-3' | (SEQ ID NO: 3780) |
|  | 3'-UAAAGUAAUAGAGGGUUCAUCGGUCAC-5' | (SEQ ID NO: 900) |
| CKAP5-4780 Target: | 5'-ATTTCATTATCTCCCAAGTAGCCAGTG-3' | (SEQ ID NO: 1476) |
|  | 5'-UUCAUUAUCUCCCAAGUAGCCAGUGGU-3' | (SEQ ID NO: 3781) |
|  | 3'-AAGUAAUAGAGGGUUCAUCGGUCACCA-5' | (SEQ ID NO: 901) |
| CKAP5-4782 Target: | 5'-TTCATTATCTCCCAAGTAGCCAGTGGT-3' | (SEQ ID NO: 1477) |
|  | 5'-CAUUAUCUCCCAAGUAGCCAGUGGUGA-3' | (SEQ ID NO: 3782) |
|  | 3'-GUAAUAGAGGGUUCAUCGGUCACCACU-5' | (SEQ ID NO: 902) |
| CKAP5-4784 Target: | 5'-CATTATCTCCCAAGTAGCCAGTGGTGA-3' | (SEQ ID NO: 1478) |
|  | 5'-UUAUCUCCCAAGUAGCCAGUGGUGACA-3' | (SEQ ID NO: 3783) |
|  | 3'-AAUAGAGGGUUCAUCGGUCACCACUGU-5' | (SEQ ID NO: 903) |
| CKAP5-4786 Target: | 5'-TTATCTCCCAAGTAGCCAGTGGTGACA-3' | (SEQ ID NO: 1479) |
|  | 5'-AUCUCCCAAGUAGCCAGUGGUGACAUC-3' | (SEQ ID NO: 3784) |
|  | 3'-UAGAGGGUUCAUCGGUCACCACUGUAG-5' | (SEQ ID NO: 904) |
| CKAP5-4788 Target: | 5'-ATCTCCCAAGTAGCCAGTGGTGACATC-3' | (SEQ ID NO: 1480) |
|  | 5'-CUCCCAAGUAGCCAGUGGUGACAUCAA-3' | (SEQ ID NO: 3785) |
|  | 3'-GAGGGUUCAUCGGUCACCACUGUAGUU-5' | (SEQ ID NO: 905) |
| CKAP5-4790 Target: | 5'-CTCCCAAGTAGCCAGTGGTGACATCAA-3' | (SEQ ID NO: 1481) |
|  | 5'-CCCAAGUAGCCAGUGGUGACAUCAACA-3' | (SEQ ID NO: 3786) |
|  | 3'-GGGUUCAUCGGUCACCACUGUAGUUGU-5' | (SEQ ID NO: 906) |
| CKAP5-4792 Target: | 5'-CCCAAGTAGCCAGTGGTGACATCAACA-3' | (SEQ ID NO: 1482) |
|  | 5'-UUGCCCGGGAGGCCUCCACUGGAGUAC-3' | (SEQ ID NO: 3787) |
|  | 3'-AACGGGCCCUCCGGAGGUGACCUCAUG-5' | (SEQ ID NO: 907) |
| CKAP5-5041 Target: | 5'-TTGCCCGGGAGGCCTCCACTGGAGTAC-3' | (SEQ ID NO: 1483) |
|  | 5'-GCCCGGGAGGCCUCCACUGGAGUACUA-3' | (SEQ ID NO: 3788) |
|  | 3'-CGGGCCCUCCGGAGGUGACCUCAUGAU-5' | (SEQ ID NO: 908) |
| CKAP5-5043 Target: | 5'-GCCCGGGAGGCCTCCACTGGAGTACTA-3' | (SEQ ID NO: 1484) |
|  | 5'-CCGGGAGGCCUCCACUGGAGUACUAAA-3' | (SEQ ID NO: 3789) |
|  | 3'-GGCCCUCCGGAGGUGACCUCAUGAUUU-5' | (SEQ ID NO: 909) |
| CKAP5-5045 Target: | 5'-CCGGGAGGCCTCCACTGGAGTACTAAA-3' | (SEQ ID NO: 1485) |
|  | 5'-GGGAGGCCUCCACUGGAGUACUAAAAG-3' | (SEQ ID NO: 3790) |
|  | 3'-CCCUCCGGAGGUGACCUCAUGAUUUUC-5' | (SEQ ID NO: 910) |
| CKAP5-5047 Target: | 5'-GGGAGGCCTCCACTGGAGTACTAAAAG-3' | (SEQ ID NO: 1486) |
|  | 5'-UCAUCACCUUAAUGCUGGAUUCUCGGA-3' | (SEQ ID NO: 3791) |
|  | 3'-AGUAGUGGAAUUACGACCUAAGAGCCU-5' | (SEQ ID NO: 911) |
| CKAP5-5089 Target: | 5'-TCATCACCTTAATGCTGGATTCTCGGA-3' | (SEQ ID NO: 1487) |
|  | 5'-AUCACCUUAAUGCUGGAUUCUCGGAUU-3' | (SEQ ID NO: 3792) |
|  | 3'-UAGUGGAAUUACGACCUAAGAGCCUAA-5' | (SEQ ID NO: 912) |
| CKAP5-5091 Target: | 5'-ATCACCTTAATGCTGGATTCTCGGATT-3' | (SEQ ID NO: 1488) |
|  | 5'-CACCUUAAUGCUGGAUUCUCGGAUUGA-3' | (SEQ ID NO: 3793) |
|  | 3'-GUGGAAUUACGACCUAAGAGCCUAACU-5' | (SEQ ID NO: 913) |
| CKAP5-5093 Target: | 5'-CACCTTAATGCTGGATTCTCGGATTGA-3' | (SEQ ID NO: 1489) |
|  | 5'-CCUUAAUGCUGGAUUCUCGGAUUGAAG-3' | (SEQ ID NO: 3794) |
|  | 3'-GGAAUUACGACCUAAGAGCCUAACUUC-5' | (SEQ ID NO: 914) |
| CKAP5-5095 Target: | 5'-CCTTAATGCTGGATTCTCGGATTGAAG-3' | (SEQ ID NO: 1490) |

TABLE 6-continued

Selected Human Anti-CKAP5 "Blunt/Blunt" DsiRNAs

|  |  |  |
|---|---|---|
| CKAP5-5097 Target: | 5'-UUAAUGCUGGAUUCUCGGAUUGAAGAU-3'<br>3'-AAUUACGACCUAAGAGCCUAACUUCUA-5'<br>5'-TTAATGCTGGATTCTCGGATTGAAGAT-3' | (SEQ ID NO: 3795)<br>(SEQ ID NO: 915)<br>(SEQ ID NO: 1491) |
| CKAP5-5099 Target: | 5'-AAUGCUGGAUUCUCGGAUUGAAGAUCU-3'<br>3'-UUACGACCUAAGAGCCUAACUUCUAGA-5'<br>5'-AATGCTGGATTCTCGGATTGAAGATCT-3' | (SEQ ID NO: 3796)<br>(SEQ ID NO: 916)<br>(SEQ ID NO: 1492) |
| CKAP5-5101 Target: | 5'-UGCUGGAUUCUCGGAUUGAAGAUCUUG-3'<br>3'-ACGACCUAAGAGCCUAACUUCUAGAAC-5'<br>5'-TGCTGGATTCTCGGATTGAAGATCTTG-3' | (SEQ ID NO: 3797)<br>(SEQ ID NO: 917)<br>(SEQ ID NO: 1493) |
| CKAP5-5103 Target: | 5'-CUGGAUUCUCGGAUUGAAGAUCUUGAG-3'<br>3'-GACCUAAGAGCCUAACUUCUAGAACUC-5'<br>5'-CTGGATTCTCGGATTGAAGATCTTGAG-3' | (SEQ ID NO: 3798)<br>(SEQ ID NO: 918)<br>(SEQ ID NO: 1494) |
| CKAP5-5105 Target: | 5'-GGAUUCUCGGAUUGAAGAUCUUGAGGA-3'<br>3'-CCUAAGAGCCUAACUUCUAGAACUCCU-5'<br>5'-GGATTCTCGGATTGAAGATCTTGAGGA-3' | (SEQ ID NO: 3799)<br>(SEQ ID NO: 919)<br>(SEQ ID NO: 1495) |
| CKAP5-5150 Target: | 5'-CUCUGUGAACCUCUUGGUGGUGAAGGU-3'<br>3'-GAGACACUUGGAGAACCACCACUUCCA-5'<br>5'-CTCTGTGAACCTCTTGGTGGTGAAGGT-3' | (SEQ ID NO: 3800)<br>(SEQ ID NO: 920)<br>(SEQ ID NO: 1496) |
| CKAP5-5152 Target: | 5'-CUGUGAACCUCUUGGUGGUGAAGGUUC-3'<br>3'-GACACUUGGAGAACCACCACUUCCAAG-5'<br>5'-CTGTGAACCTCTTGGTGGTGAAGGTTC-3' | (SEQ ID NO: 3801)<br>(SEQ ID NO: 921)<br>(SEQ ID NO: 1497) |
| CKAP5-5154 Target: | 5'-GUGAACCUCUUGGUGGUGAAGGUUCUG-3'<br>3'-CACUUGGAGAACCACCACUUCCAAGAC-5'<br>5'-GTGAACCTCTTGGTGGTGAAGGTTCTG-3' | (SEQ ID NO: 3802)<br>(SEQ ID NO: 922)<br>(SEQ ID NO: 1498) |
| CKAP5-5156 Target: | 5'-GAACCUCUUGGUGGUGAAGGUUCUGGA-3'<br>3'-CUUGGAGAACCACCACUUCCAAGACCU-5'<br>5'-GAACCTCTTGGTGGTGAAGGTTCTGGA-3' | (SEQ ID NO: 3803)<br>(SEQ ID NO: 923)<br>(SEQ ID NO: 1499) |
| CKAP5-5230 Target: | 5'-AAGACAGCCUGCUAGCAACAGCCAGUU-3'<br>3'-UUCUGUCGGACGAUCGUUGUCGGUCAA-5'<br>5'-AAGACAGCCTGCTAGCAACAGCCAGTT-3' | (SEQ ID NO: 3804)<br>(SEQ ID NO: 924)<br>(SEQ ID NO: 1500) |
| CKAP5-5251 Target: | 5'-CCAGUUCUCCCAAAUUCUCAGAGCUUG-3'<br>3'-GGUCAAGAGGGUUUAAGAGUCUCGAAC-5'<br>5'-CCAGTTCTCCCAAATTCTCAGAGCTTG-3' | (SEQ ID NO: 3805)<br>(SEQ ID NO: 925)<br>(SEQ ID NO: 1501) |
| CKAP5-5253 Target: | 5'-AGUUCUCCCAAAUUCUCAGAGCUUGUU-3'<br>3'-UCAAGAGGGUUUAAGAGUCUCGAACAA-5'<br>5'-AGTTCTCCCAAATTCTCAGAGCTTGTT-3' | (SEQ ID NO: 3806)<br>(SEQ ID NO: 926)<br>(SEQ ID NO: 1502) |
| CKAP5-5255 Target: | 5'-UUCUCCCAAAUUCUCAGAGCUUGUUAU-3'<br>3'-AAGAGGGUUUAAGAGUCUCGAACAAUA-5'<br>5'-TTCTCCCAAATTCTCAGAGCTTGTTAT-3' | (SEQ ID NO: 3807)<br>(SEQ ID NO: 927)<br>(SEQ ID NO: 1503) |
| CKAP5-5257 Target: | 5'-CUCCCAAAUUCUCAGAGCUUGUUAUGA-3'<br>3'-GAGGGUUUAAGAGUCUCGAACAAUACU-5'<br>5'-CTCCCAAATTCTCAGAGCTTGTTATGA-3' | (SEQ ID NO: 3808)<br>(SEQ ID NO: 928)<br>(SEQ ID NO: 1504) |
| CKAP5-5259 Target: | 5'-CCCAAAUUCUCAGAGCUUGUUAUGAAG-3'<br>3'-GGGUUUAAGAGUCUCGAACAAUACUUC-5'<br>5'-CCCAAATTCTCAGAGCTTGTTATGAAG-3' | (SEQ ID NO: 3809)<br>(SEQ ID NO: 929)<br>(SEQ ID NO: 1505) |
| CKAP5-5261 Target: | 5'-CAAAUUCUCAGAGCUUGUUAUGAAGUG-3'<br>3'-GUUUAAGAGUCUCGAACAAUACUUCAC-5'<br>5'-CAAATTCTCAGAGCTTGTTATGAAGTG-3' | (SEQ ID NO: 3810)<br>(SEQ ID NO: 930)<br>(SEQ ID NO: 1506) |
| CKAP5-5263 Target: | 5'-AAUUCUCAGAGCUUGUUAUGAAGUGUC-3'<br>3'-UUAAGAGUCUCGAACAAUACUUCACAG-5'<br>5'-AATTCTCAGAGCTTGTTATGAAGTGTC-3' | (SEQ ID NO: 3811)<br>(SEQ ID NO: 931)<br>(SEQ ID NO: 1507) |
| CKAP5-5265 Target: | 5'-UUCUCAGAGCUUGUUAUGAAGUGUCUC-3'<br>3'-AAGAGUCUCGAACAAUACUUCACAGAG-5'<br>5'-TTCTCAGAGCTTGTTATGAAGTGTCTC-3' | (SEQ ID NO: 3812)<br>(SEQ ID NO: 932)<br>(SEQ ID NO: 1508) |
| CKAP5-5267 Target: | 5'-CUCAGAGCUUGUUAUGAAGUGUCUCUG-3'<br>3'-GAGUCUCGAACAAUACUUCACAGAGAC-5'<br>5'-CTCAGAGCTTGTTATGAAGTGTCTCTG-3' | (SEQ ID NO: 3813)<br>(SEQ ID NO: 933)<br>(SEQ ID NO: 1509) |

TABLE 6-continued

Selected Human Anti-CKAP5 "Blunt/Blunt" DsiRNAs

```
                5'-CAGAGCUUGUUAUGAAGUGUCUCUGGA-3'   (SEQ ID NO: 3814)
                3'-GUCUCGAACAAUACUUCACAGAGACCU-5'   (SEQ ID NO: 934)
CKAP5-5269 Target: 5'-CAGAGCTTGTTATGAAGTGTCTCTGGA-3' (SEQ ID NO: 1510)

5'-AUAGCAUUAACCUAGACAGAAUUCUUC-3'   (SEQ ID NO: 3815)
                3'-UAUCGUAAUUGGAUCUGUCUUAAGAAG-5'   (SEQ ID NO: 935)
CKAP5-5326 Target: 5'-ATAGCATTAACCTAGACAGAATTCTTC-3' (SEQ ID NO: 1511)

5'-AGCAUUAACCUAGACAGAAUUCUUCUG-3'   (SEQ ID NO: 3816)
                3'-UCGUAAUUGGAUCUGUCUUAAGAAGAC-5'   (SEQ ID NO: 936)
CKAP5-5328 Target: 5'-AGCATTAACCTAGACAGAATTCTTCTG-3' (SEQ ID NO: 1512)

5'-CAUUAACCUAGACAGAAUUCUUCUGGA-3'   (SEQ ID NO: 3817)
                3'-GUAAUUGGAUCUGUCUUAAGAAGACCU-5'   (SEQ ID NO: 937)
CKAP5-5330 Target: 5'-CATTAACCTAGACAGAATTCTTCTGGA-3' (SEQ ID NO: 1513)

5'-UUAACCUAGACAGAAUUCUUCUGGAUA-3'   (SEQ ID NO: 3818)
                3'-AAUUGGAUCUGUCUUAAGAAGACCUAU-5'   (SEQ ID NO: 938)
CKAP5-5332 Target: 5'-TTAACCTAGACAGAATTCTTCTGGATA-3' (SEQ ID NO: 1514)

5'-AACCUAGACAGAAUUCUUCUGGAUAUC-3'   (SEQ ID NO: 3819)
                3'-UUGGAUCUGUCUUAAGAAGACCUAUAG-5'   (SEQ ID NO: 939)
CKAP5-5334 Target: 5'-AACCTAGACAGAATTCTTCTGGATATC-3' (SEQ ID NO: 1515)

5'-CCUAGACAGAAUUCUUCUGGAUAUCCA-3'   (SEQ ID NO: 3820)
                3'-GGAUCUGUCUUAAGAAGACCUAUAGGU-5'   (SEQ ID NO: 940)
CKAP5-5336 Target: 5'-CCTAGACAGAATTCTTCTGGATATCCA-3' (SEQ ID NO: 1516)

5'-UAUCCACAUUUUCAUGAAGGUCUUCCC-3'   (SEQ ID NO: 3821)
                3'-AUAGGUGUAAAAGUACUUCCAGAAGGG-5'   (SEQ ID NO: 941)
CKAP5-5357 Target: 5'-TATCCACATTTTCATGAAGGTCTTCCC-3' (SEQ ID NO: 1517)

5'-CUGAAGCAAUGCAAAAGUGAAUUUCCC-3'   (SEQ ID NO: 3822)
                3'-GACUUCGUUACGUUUUCACUUAAAGGG-5'   (SEQ ID NO: 942)
CKAP5-5394 Target: 5'-CTGAAGCAATGCAAAAGTGAATTTCCC-3' (SEQ ID NO: 1518)

5'-GAAGCAAUGCAAAAGUGAAUUUCCCAU-3'   (SEQ ID NO: 3823)
                3'-CUUCGUUACGUUUUCACUUAAAGGGUA-5'   (SEQ ID NO: 943)
CKAP5-5396 Target: 5'-GAAGCAATGCAAAAGTGAATTTCCCAT-3' (SEQ ID NO: 1519)

5'-AGCAAUGCAAAAGUGAAUUUCCCAUAA-3'   (SEQ ID NO: 3824)
                3'-UCGUUACGUUUUCACUUAAAGGGUAUU-5'   (SEQ ID NO: 944)
CKAP5-5398 Target: 5'-AGCAATGCAAAAGTGAATTTCCCATAA-3' (SEQ ID NO: 1520)

5'-ACAGUAUGGACCAGACUGGGAGCAAGU-3'   (SEQ ID NO: 3825)
                3'-UGUCAUACCUGGUCUGACCCUCGUUCA-5'   (SEQ ID NO: 945)
CKAP5-5551 Target: 5'-ACAGTATGGACCAGACTGGGAGCAAGT-3' (SEQ ID NO: 1521)

5'-AGUAUGGACCAGACUGGGAGCAAGUCU-3'   (SEQ ID NO: 3826)
                3'-UCAUACCUGGUCUGACCCUCGUUCAGA-5'   (SEQ ID NO: 946)
CKAP5-5553 Target: 5'-AGTATGGACCAGACTGGGAGCAAGTCT-3' (SEQ ID NO: 1522)

5'-UAUGGACCAGACUGGGAGCAAGUCUGA-3'   (SEQ ID NO: 3827)
                3'-AUACCUGGUCUGACCCUCGUUCAGACU-5'   (SEQ ID NO: 947)
CKAP5-5555 Target: 5'-TATGGACCAGACTGGGAGCAAGTCTGA-3' (SEQ ID NO: 1523)

5'-UGGACCAGACUGGGAGCAAGUCUGAUA-3'   (SEQ ID NO: 3828)
                3'-ACCUGGUCUGACCCUCGUUCAGACUAU-5'   (SEQ ID NO: 948)
CKAP5-5557 Target: 5'-TGGACCAGACTGGGAGCAAGTCTGATA-3' (SEQ ID NO: 1524)

5'-GACCAGACUGGGAGCAAGUCUGAUAAG-3'   (SEQ ID NO: 3829)
                3'-CUGGUCUGACCCUCGUUCAGACUAUUC-5'   (SEQ ID NO: 949)
CKAP5-5559 Target: 5'-GACCAGACTGGGAGCAAGTCTGATAAG-3' (SEQ ID NO: 1525)

5'-CCAGACUGGGAGCAAGUCUGAUAAGGA-3'   (SEQ ID NO: 3830)
                3'-GGUCUGACCCUCGUUCAGACUAUUCCU-5'   (SEQ ID NO: 950)
CKAP5-5561 Target: 5'-CCAGACTGGGAGCAAGTCTGATAAGGA-3' (SEQ ID NO: 1526)

5'-AGACUGGGAGCAAGUCUGAUAAGGAAA-3'   (SEQ ID NO: 3831)
                3'-UCUGACCCUCGUUCAGACUAUUCCUUU-5'   (SEQ ID NO: 951)
CKAP5-5563 Target: 5'-AGACTGGGAGCAAGTCTGATAAGGAAA-3' (SEQ ID NO: 1527)

5'-ACUGGGAGCAAGUCUGAUAAGGAAACA-3'   (SEQ ID NO: 3832)
                3'-UGACCCUCGUUCAGACUAUUCCUUUGU-5'   (SEQ ID NO: 952)
CKAP5-5565 Target: 5'-ACTGGGAGCAAGTCTGATAAGGAAACA-3' (SEQ ID NO: 1528)
```

TABLE 6-continued

Selected Human Anti-CKAP5 "Blunt/Blunt" DsiRNAs

```
                     5'-UGGGAGCAAGUCUGAUAAGGAAACAGA-3'      (SEQ ID NO: 3833)
                     3'-ACCCUCGUUCAGACUAUUCCUUUGUCU-5'      (SEQ ID NO: 953)
CKAP5-5567 Target: 5'-TGGGAGCAAGTCTGATAAGGAAACAGA-3'        (SEQ ID NO: 1529)

5'-GGAGCAAGUCUGAUAAGGAAACAGAAA-3'      (SEQ ID NO: 3834)
                     3'-CCUCGUUCAGACUAUUCCUUUGUCUUU-5'      (SEQ ID NO: 954)
CKAP5-5569 Target: 5'-GGAGCAAGTCTGATAAGGAAACAGAAA-3'        (SEQ ID NO: 1530)

5'-AGCAAGUCUGAUAAGGAAACAGAAAAG-3'      (SEQ ID NO: 3835)
                     3'-UCGUUCAGACUAUUCCUUUGUCUUUUC-5'      (SEQ ID NO: 955)
CKAP5-5571 Target: 5'-AGCAAGTCTGATAAGGAAACAGAAAAG-3'        (SEQ ID NO: 1531)

5'-CAAGUCUGAUAAGGAAACAGAAAAGGG-3'      (SEQ ID NO: 3836)
                     3'-GUUCAGACUAUUCCUUUGUCUUUUCCC-5'      (SEQ ID NO: 956)
CKAP5-5573 Target: 5'-CAAGTCTGATAAGGAAACAGAAAAGGG-3'        (SEQ ID NO: 1532)

5'-AGUCUGAUAAGGAAACAGAAAAGGGAG-3'      (SEQ ID NO: 3837)
                     3'-UCAGACUAUUCCUUUGUCUUUUCCCUC-5'      (SEQ ID NO: 957)
CKAP5-5575 Target: 5'-AGTCTGATAAGGAAACAGAAAAGGGAG-3'        (SEQ ID NO: 1533)

5'-UCUGAUAAGGAAACAGAAAAGGGAGCA-3'      (SEQ ID NO: 3838)
                     3'-AGACUAUUCCUUUGUCUUUUCCCUCGU-5'      (SEQ ID NO: 958)
CKAP5-5577 Target: 5'-TCTGATAAGGAAACAGAAAAGGGAGCA-3'        (SEQ ID NO: 1534)

5'-UGAUAAGGAAACAGAAAAGGGAGCAUC-3'      (SEQ ID NO: 3839)
                     3'-ACUAUUCCUUUGUCUUUUCCCUCGUAG-5'      (SEQ ID NO: 959)
CKAP5-5579 Target: 5'-TGATAAGGAAACAGAAAAGGGAGCATC-3'        (SEQ ID NO: 1535)

5'-AUAAGGAAACAGAAAAGGGAGCAUCUC-3'      (SEQ ID NO: 3840)
                     3'-UAUUCCUUUGUCUUUUCCCUCGUAGAG-5'      (SEQ ID NO: 960)
CKAP5-5581 Target: 5'-ATAAGGAAACAGAAAAGGGAGCATCTC-3'        (SEQ ID NO: 1536)

5'-CAUCUCGAAUAGAUGAAAAAUCAUCAA-3'      (SEQ ID NO: 3841)
                     3'-GUAGAGCUUAUCUACUUUUUAGUAGUU-5'      (SEQ ID NO: 961)
CKAP5-5602 Target: 5'-CATCTCGAATAGATGAAAAATCATCAA-3'        (SEQ ID NO: 1537)

5'-UCUCGAAUAGAUGAAAAAUCAUCAAAG-3'      (SEQ ID NO: 3842)
                     3'-AGAGCUUAUCUACUUUUUAGUAGUUUC-5'      (SEQ ID NO: 962)
CKAP5-5604 Target: 5'-TCTCGAATAGATGAAAAATCATCAAAG-3'        (SEQ ID NO: 1538)

5'-UCGAAUAGAUGAAAAAUCAUCAAAGGC-3'      (SEQ ID NO: 3843)
                     3'-AGCUUAUCUACUUUUUAGUAGUUUCCG-5'      (SEQ ID NO: 963)
CKAP5-5606 Target: 5'-TCGAATAGATGAAAAATCATCAAAGGC-3'        (SEQ ID NO: 1539)

5'-GAAUAGAUGAAAAAUCAUCAAAGGCCA-3'      (SEQ ID NO: 3844)
                     3'-CUUAUCUACUUUUUAGUAGUUUCCGGU-5'      (SEQ ID NO: 964)
CKAP5-5608 Target: 5'-GAATAGATGAAAAATCATCAAAGGCCA-3'        (SEQ ID NO: 1540)

5'-AUAGAUGAAAAAUCAUCAAAGGCCAAA-3'      (SEQ ID NO: 3845)
                     3'-UAUCUACUUUUUAGUAGUUUCCGGUUU-5'      (SEQ ID NO: 965)
CKAP5-5610 Target: 5'-ATAGATGAAAAATCATCAAAGGCCAAA-3'        (SEQ ID NO: 1541)

5'-AGAUGAAAAAUCAUCAAAGGCCAAAGU-3'      (SEQ ID NO: 3846)
                     3'-UCUACUUUUUAGUAGUUUCCGGUUUCA-5'      (SEQ ID NO: 966)
CKAP5-5612 Target: 5'-AGATGAAAAATCATCAAAGGCCAAAGT-3'        (SEQ ID NO: 1542)

5'-AUGAAAAAUCAUCAAAGGCCAAAGUGA-3'      (SEQ ID NO: 3847)
                     3'-UACUUUUUAGUAGUUUCCGGUUUCACU-5'      (SEQ ID NO: 967)
CKAP5-5614 Target: 5'-ATGAAAAATCATCAAAGGCCAAAGTGA-3'        (SEQ ID NO: 1543)

5'-GAAAAAUCAUCAAAGGCCAAAGUGAAU-3'      (SEQ ID NO: 3848)
                     3'-CUUUUUAGUAGUUUCCGGUUUCACUUA-5'      (SEQ ID NO: 968)
CKAP5-5616 Target: 5'-GAAAAATCATCAAAGGCCAAAGTGAAT-3'        (SEQ ID NO: 1544)

5'-AAAAUCAUCAAAGGCCAAAGUGAAUGA-3'      (SEQ ID NO: 3849)
                     3'-UUUUAGUAGUUUCCGGUUUCACUUACU-5'      (SEQ ID NO: 969)
CKAP5-5618 Target: 5'-AAAATCATCAAAGGCCAAAGTGAATGA-3'        (SEQ ID NO: 1545)

5'-GAAUGAUUUCUUAGCUGAGAUUUUUAA-3'      (SEQ ID NO: 3850)
                     3'-CUUACUAAAGAAUCGACUCUAAAAAUU-5'      (SEQ ID NO: 970)
CKAP5-5639 Target: 5'-GAATGATTTCTTAGCTGAGATTTTTAA-3'        (SEQ ID NO: 1546)

5'-AUGAUUUCUUAGCUGAGAUUUUUAAGA-3'      (SEQ ID NO: 3851)
                     3'-UACUAAAGAAUCGACUCUAAAAAUUCU-5'      (SEQ ID NO: 971)
CKAP5-5641 Target: 5'-ATGATTTCTTAGCTGAGATTTTTAAGA-3'        (SEQ ID NO: 1547)
```

TABLE 6-continued

Selected Human Anti-CKAP5 "Blunt/Blunt" DsiRNAs

```
                 5'-GAUUUCUUAGCUGAGAUUUUUAAGAAG-3'    (SEQ ID NO: 3852)
                 3'-CUAAAGAAUCGACUCUAAAAAUUCUUC-5'    (SEQ ID NO: 972)
CKAP5-5643 Target:5'-GATTTCTTAGCTGAGATTTTTAAGAAG-3'   (SEQ ID NO: 1548)

5'-UUUCUUAGCUGAGAUUUUUAAGAAGAU-3'    (SEQ ID NO: 3853)
                 3'-AAAGAAUCGACUCUAAAAAUUCUUCUA-5'    (SEQ ID NO: 973)
CKAP5-5645 Target:5'-TTTCTTAGCTGAGATTTTTAAGAAGAT-3'   (SEQ ID NO: 1549)

5'-UCUUAGCUGAGAUUUUUAAGAAGAUUG-3'    (SEQ ID NO: 3854)
                 3'-AGAAUCGACUCUAAAAAUUCUUCUAAC-5'    (SEQ ID NO: 974)
CKAP5-5647 Target:5'-TCTTAGCTGAGATTTTTAAGAAGATTG-3'   (SEQ ID NO: 1550)

5'-UUAGCUGAGAUUUUUAAGAAGAUUGGC-3'    (SEQ ID NO: 3855)
                 3'-AAUCGACUCUAAAAAUUCUUCUAACCG-5'    (SEQ ID NO: 975)
CKAP5-5649 Target:5'-TTAGCTGAGATTTTTAAGAAGATTGGC-3'   (SEQ ID NO: 1551)

5'-AGCUGAGAUUUUUAAGAAGAUUGGCUC-3'    (SEQ ID NO: 3856)
                 3'-UCGACUCUAAAAAUUCUUCUAACCGAG-5'    (SEQ ID NO: 976)
CKAP5-5651 Target:5'-AGCTGAGATTTTTAAGAAGATTGGCTC-3'   (SEQ ID NO: 1552)

5'-CUGAGAUUUUUAAGAAGAUUGGCUCUA-3'    (SEQ ID NO: 3857)
                 3'-GACUCUAAAAAUUCUUCUAACCGAGAU-5'    (SEQ ID NO: 977)
CKAP5-5653 Target:5'-CTGAGATTTTTAAGAAGATTGGCTCTA-3'   (SEQ ID NO: 1553)

5'-GAGAUUUUUAAGAAGAUUGGCUCUAAA-3'    (SEQ ID NO: 3858)
                 3'-CUCUAAAAAUUCUUCUAACCGAGAUUU-5'    (SEQ ID NO: 978)
CKAP5-5655 Target:5'-GAGATTTTTAAGAAGATTGGCTCTAAA-3'   (SEQ ID NO: 1554)

5'-GAUUUUUAAGAAGAUUGGCUCUAAAGA-3'    (SEQ ID NO: 3859)
                 3'-CUAAAAAUUCUUCUAACCGAGAUUUCU-5'    (SEQ ID NO: 979)
CKAP5-5657 Target:5'-GATTTTTAAGAAGATTGGCTCTAAAGA-3'   (SEQ ID NO: 1555)

5'-ACUAGCAGAGUUAUAUGAAUAUAAGAA-3'    (SEQ ID NO: 3860)
                 3'-UGAUCGUCUCAAUAUACUUAUAUUCUU-5'    (SEQ ID NO: 980)
CKAP5-5699 Target:5'-ACTAGCAGAGTTATATGAATATAAGAA-3'   (SEQ ID NO: 1556)

5'-UAGCAGAGUUAUAUGAAUAUAAGAAGA-3'    (SEQ ID NO: 3861)
                 3'-AUCGUCUCAAUAUACUUAUAUUCUUCU-5'    (SEQ ID NO: 981)
CKAP5-5701 Target:5'-TAGCAGAGTTATATGAATATAAGAAGA-3'   (SEQ ID NO: 1557)

5'-GCAGAGUUAUAUGAAUAUAAGAAGAAA-3'    (SEQ ID NO: 3862)
                 3'-CGUCUCAAUAUACUUAUAUUCUUCUUU-5'    (SEQ ID NO: 982)
CKAP5-5703 Target:5'-GCAGAGTTATATGAATATAAGAAGAAA-3'   (SEQ ID NO: 1558)

5'-AGAGUUAUAUGAAUAUAAGAAGAAAUA-3'    (SEQ ID NO: 3863)
                 3'-UCUCAAUAUACUUAUAUUCUUCUUUAU-5'    (SEQ ID NO: 983)
CKAP5-5705 Target:5'-AGAGTTATATGAATATAAGAAGAAATA-3'   (SEQ ID NO: 1559)

5'-AGUUAUAUGAAUAUAAGAAGAAAUACU-3'    (SEQ ID NO: 3864)
                 3'-UCAAUAUACUUAUAUUCUUCUUUAUGA-5'    (SEQ ID NO: 984)
CKAP5-5707 Target:5'-AGTTATATGAATATAAGAAGAAATACT-3'   (SEQ ID NO: 1560)

5'-UUAUAUGAAUAUAAGAAGAAAUACUCA-3'    (SEQ ID NO: 3865)
                 3'-AAUAUACUUAUAUUCUUCUUUAUGAGU-5'    (SEQ ID NO: 985)
CKAP5-5709 Target:5'-TTATATGAATATAAGAAGAAATACTCA-3'   (SEQ ID NO: 1561)

5'-AUAUGAAUAUAAGAAGAAAUACUCAGA-3'    (SEQ ID NO: 3866)
                 3'-UAUACUUAUAUUCUUCUUUAUGAGUCU-5'    (SEQ ID NO: 986)
CKAP5-5711 Target:5'-ATATGAATATAAGAAGAAATACTCAGA-3'   (SEQ ID NO: 1562)

5'-GCUGACAUUGAACCAUUUCUGAAAAAU-3'    (SEQ ID NO: 3867)
                 3'-CGACUGUAACUUGGUAAAGACUUUUUA-5'    (SEQ ID NO: 987)
CKAP5-5739 Target:5'-GCTGACATTGAACCATTTCTGAAAAAT-3'   (SEQ ID NO: 1563)

5'-UGACAUUGAACCAUUUCUGAAAAAUUC-3'    (SEQ ID NO: 3868)
                 3'-ACUGUAACUUGGUAAAGACUUUUUAAG-5'    (SEQ ID NO: 988)
CKAP5-5741 Target:5'-TGACATTGAACCATTTCTGAAAAATTC-3'   (SEQ ID NO: 1564)

5'-ACAUUGAACCAUUUCUGAAAAAUUCCU-3'    (SEQ ID NO: 3869)
                 3'-UGUAACUUGGUAAAGACUUUUUAAGGA-5'    (SEQ ID NO: 989)
CKAP5-5743 Target:5'-ACATTGAACCATTTCTGAAAAATTCCT-3'   (SEQ ID NO: 1565)

5'-AUUGAACCAUUUCUGAAAAAUUCCUCA-3'    (SEQ ID NO: 3870)
                 3'-UAACUUGGUAAAGACUUUUUAAGGAGU-5'    (SEQ ID NO: 990)
CKAP5-5745 Target:5'-ATTGAACCATTTCTGAAAAATTCCTCA-3'   (SEQ ID NO: 1566)
```

TABLE 6-continued

Selected Human Anti-CKAP5 "Blunt/Blunt" DsiRNAs

```
                 5'-UGAACCAUUUCUGAAAAAUUCCUCACA-3'    (SEQ ID NO: 3871)
                 3'-ACUUGGUAAAGACUUUUUAAGGAGUGU-5'    (SEQ ID NO: 991)
CKAP5-5747 Target:5'-TGAACCATTTCTGAAAAATTCCTCACA-3'   (SEQ ID NO: 1567)

5'-AACCAUUUCUGAAAAAUUCCUCACAGU-3'    (SEQ ID NO: 3872)
                 3'-UUGGUAAAGACUUUUUAAGGAGUGUCA-5'    (SEQ ID NO: 992)
CKAP5-5749 Target:5'-AACCATTTCTGAAAAATTCCTCACAGT-3'   (SEQ ID NO: 1568)

5'-AAAGAGGCCUUCGGGUGAUUGAGAUGG-3'    (SEQ ID NO: 3873)
                 3'-UUUCUCCGGAAGCCCACUAACUCUACC-5'    (SEQ ID NO: 993)
CKAP5-5794 Target:5'-AAAGAGGCCTTCGGGTGATTGAGATGG-3'   (SEQ ID NO: 1569)

5'-AGAGGCCUUCGGGUGAUUGAGAUGGAG-3'    (SEQ ID NO: 3874)
                 3'-UCUCCGGAAGCCCACUAACUCUACCUC-5'    (SEQ ID NO: 994)
CKAP5-5796 Target:5'-AGAGGCCTTCGGGTGATTGAGATGGAG-3'   (SEQ ID NO: 1570)

5'-AGGCCUUCGGGUGAUUGAGAUGGAGAG-3'    (SEQ ID NO: 3875)
                 3'-UCCGGAAGCCCACUAACUCUACCUCUC-5'    (SEQ ID NO: 995)
CKAP5-5798 Target:5'-AGGCCTTCGGGTGATTGAGATGGAGAG-3'   (SEQ ID NO: 1571)

5'-GCCUUCGGGUGAUUGAGAUGGAGAGGG-3'    (SEQ ID NO: 3876)
                 3'-CGGAAGCCCACUAACUCUACCUCUCCC-5'    (SEQ ID NO: 996)
CKAP5-5800 Target:5'-GCCTTCGGGTGATTGAGATGGAGAGGG-3'   (SEQ ID NO: 1572)

5'-CUUCGGGUGAUUGAGAUGGAGAGGGAG-3'    (SEQ ID NO: 3877)
                 3'-GAAGCCCACUAACUCUACCUCUCCCUC-5'    (SEQ ID NO: 997)
CKAP5-5802 Target:5'-CTTCGGGTGATTGAGATGGAGAGGGAG-3'   (SEQ ID NO: 1573)

5'-UCGGGUGAUUGAGAUGGAGAGGGAGGG-3'    (SEQ ID NO: 3878)
                 3'-AGCCCACUAACUCUACCUCUCCCUCCC-5'    (SEQ ID NO: 998)
CKAP5-5804 Target:5'-TCGGGTGATTGAGATGGAGAGGGAGGG-3'   (SEQ ID NO: 1574)

5'-GGCCAUCUGUCUACUUGGAAAGGCUAA-3'    (SEQ ID NO: 3879)
                 3'-CCGGUAGACAGAUGAACCUUUCCGAUU-5'    (SEQ ID NO: 999)
CKAP5-5944 Target:5'-GGCCATCTGTCTACTTGGAAAGGCTAA-3'   (SEQ ID NO: 1575)

5'-CCAUCUGUCUACUUGGAAAGGCUAAAG-3'    (SEQ ID NO: 3880)
                 3'-GGUAGACAGAUGAACCUUUCCGAUUUC-5'    (SEQ ID NO: 1000)
CKAP5-5946 Target:5'-CCATCTGTCTACTTGGAAAGGCTAAAG-3'   (SEQ ID NO: 1576)

5'-AUCUGUCUACUUGGAAAGGCUAAAGAU-3'    (SEQ ID NO: 3881)
                 3'-UAGACAGAUGAACCUUUCCGAUUUCUA-5'    (SEQ ID NO: 1001)
CKAP5-5948 Target:5'-ATCTGTCTACTTGGAAAGGCTAAAGAT-3'   (SEQ ID NO: 1577)

5'-CUGUCUACUUGGAAAGGCUAAAGAUCC-3'    (SEQ ID NO: 3882)
                 3'-GACAGAUGAACCUUUCCGAUUUCUAGG-5'    (SEQ ID NO: 1002)
CKAP5-5950 Target:5'-CTGTCTACTTGGAAAGGCTAAAGATCC-3'   (SEQ ID NO: 1578)

5'-UUUGACCUCUUUGCUCUCCAAACCAGC-3'    (SEQ ID NO: 3883)
                 3'-AAACUGGAGAAACGAGAGGUUUGGUCG-5'    (SEQ ID NO: 1003)
CKAP5-6026 Target:5'-TTTGACCTCTTTGCTCTCCAAACCAGC-3'   (SEQ ID NO: 1579)

5'-UGACCUCUUUGCUCUCCAAACCAGCAG-3'    (SEQ ID NO: 3884)
                 3'-ACUGGAGAAACGAGAGGUUUGGUCGUC-5'    (SEQ ID NO: 1004)
CKAP5-6028 Target:5'-TGACCTCTTTGCTCTCCAAACCAGCAG-3'   (SEQ ID NO: 1580)

5'-ACCUCUUUGCUCUCCAAACCAGCAGUU-3'    (SEQ ID NO: 3885)
                 3'-UGGAGAAACGAGAGGUUUGGUCGUCAA-5'    (SEQ ID NO: 1005)
CKAP5-6030 Target:5'-ACCTCTTTGCTCTCCAAACCAGCAGTT-3'   (SEQ ID NO: 1581)

5'-CUCUUUGCUCUCCAAACCAGCAGUUCC-3'    (SEQ ID NO: 3886)
                 3'-GAGAAACGAGAGGUUUGGUCGUCAAGG-5'    (SEQ ID NO: 1006)
CKAP5-6032 Target:5'-CTCTTTGCTCTCCAAACCAGCAGTTCC-3'   (SEQ ID NO: 1582)

5'-UGUGACCUCCUCCUCCUCCACAGCUAA-3'    (SEQ ID NO: 3887)
                 3'-ACACUGGAGGAGGAGGAGGUGUCGAUU-5'    (SEQ ID NO: 1007)
CKAP5-6173 Target:5'-TGTGACCTCCTCCTCCTCCACAGCTAA-3'   (SEQ ID NO: 1583)

5'-AAAGACUGGAGAGAAUAAAGAGCAGUC-3'    (SEQ ID NO: 3888)
                 3'-UUUCUGACCUCUCUUAUUUCUCGUCAG-5'    (SEQ ID NO: 1008)
CKAP5-6217 Target:5'-AAAGACTGGAGAGAATAAAGAGCAGTC-3'   (SEQ ID NO: 1584)

5'-AGACUGGAGAGAAUAAAGAGCAGUCGC-3'    (SEQ ID NO: 3889)
                 3'-UCUGACCUCUCUUAUUUCUCGUCAGCG-5'    (SEQ ID NO: 1009)
CKAP5-6219 Target:5'-AGACTGGAGAGAATAAAGAGCAGTCGC-3'   (SEQ ID NO: 1585)
```

TABLE 6-continued

Selected Human Anti-CKAP5 "Blunt/Blunt" DsiRNAs

```
                5'-ACUGGAGAGAAUAAAGAGCAGUCGCAA-3'  (SEQ ID NO: 3890)
                3'-UGACCUCUCUUAUUUCUCGUCAGCGUU-5'  (SEQ ID NO: 1010)
CKAP5-6221 Target:5'-ACTGGAGAGAATAAAGAGCAGTCGCAA-3' (SEQ ID NO: 1586)

5'-UGGAGAGAAUAAAGAGCAGUCGCAAAU-3'  (SEQ ID NO: 3891)
                3'-ACCUCUCUUAUUUCUCGUCAGCGUUUA-5'  (SEQ ID NO: 1011)
CKAP5-6223 Target:5'-TGGAGAGAATAAAGAGCAGTCGCAAAT-3' (SEQ ID NO: 1587)

5'-GAGAGAAUAAAGAGCAGUCGCAAAUGA-3'  (SEQ ID NO: 3892)
                3'-CUCUCUUAUUUCUCGUCAGCGUUUACU-5'  (SEQ ID NO: 1012)
CKAP5-6225 Target:5'-GAGAGAATAAAGAGCAGTCGCAAATGA-3' (SEQ ID NO: 1588)

5'-GAGAAUAAAGAGCAGUCGCAAAUGAAG-3'  (SEQ ID NO: 3893)
                3'-CUCUUAUUUCUCGUCAGCGUUUACUUC-5'  (SEQ ID NO: 1013)
CKAP5-6227 Target:5'-GAGAATAAAGAGCAGTCGCAAATGAAG-3' (SEQ ID NO: 1589)

5'-GAAUAAAGAGCAGUCGCAAAUGAAGCU-3'  (SEQ ID NO: 3894)
                3'-CUUAUUUCUCGUCAGCGUUUACUUCGA-5'  (SEQ ID NO: 1014)
CKAP5-6229 Target:5'-GAATAAAGAGCAGTCGCAAATGAAGCT-3' (SEQ ID NO: 1590)

5'-AUAAAGAGCAGUCGCAAAUGAAGCUGC-3'  (SEQ ID NO: 3895)
                3'-UAUUUCUCGUCAGCGUUUACUUCGACG-5'  (SEQ ID NO: 1015)
CKAP5-6231 Target:5'-ATAAAGAGCAGTCGCAAATGAAGCTGC-3' (SEQ ID NO: 1591)

5'-AAAGAGCAGUCGCAAAUGAAGCUGCCC-3'  (SEQ ID NO: 3896)
                3'-UUUCUCGUCAGCGUUUACUUCGACGGG-5'  (SEQ ID NO: 1016)
CKAP5-6233 Target:5'-AAAGAGCAGTCGCAAATGAAGCTGCCC-3' (SEQ ID NO: 1592)

5'-ACAAACUGGUUGUAUGUAUCAUGCCGU-3'  (SEQ ID NO: 3897)
                3'-UGUUUGACCAACAUACAUAGUACGGCA-5'  (SEQ ID NO: 1017)
CKAP5-6342 Target:5'-ACAAACTGGTTGTATGTATCATGCCGT-3' (SEQ ID NO: 1593)

5'-UGCUCAUUUGUAAAAUUGUCCUAAUCU-3'  (SEQ ID NO: 3898)
                3'-ACGAGUAAACAUUUUAACAGGAUUAGA-5'  (SEQ ID NO: 1018)
CKAP5-6544 Target:5'-TGCTCATTTGTAAAATTGTCCTAATCT-3' (SEQ ID NO: 1594)

5'-CUCAUUUGUAAAAUUGUCCUAAUCUUU-3'  (SEQ ID NO: 3899)
                3'-GAGUAAACAUUUUAACAGGAUUAGAAA-5'  (SEQ ID NO: 1019)
CKAP5-6546 Target:5'-CTCATTTGTAAAATTGTCCTAATCTTT-3' (SEQ ID NO: 1595)

5'-CAUUUGUAAAAUUGUCCUAAUCUUUCC-3'  (SEQ ID NO: 3900)
                3'-GUAAACAUUUUAACAGGAUUAGAAAGG-5'  (SEQ ID NO: 1020)
CKAP5-6548 Target:5'-CATTTGTAAAATTGTCCTAATCTTTCC-3' (SEQ ID NO: 1596)

5'-UCACUGUAUUCUGUAUGAAUGCAUGGC-3'  (SEQ ID NO: 3901)
                3'-AGUGACAUAAGACAUACUUACGUACCG-5'  (SEQ ID NO: 1021)
CKAP5-6656 Target:5'-TCACTGTATTCTGTATGAATGCATGGC-3' (SEQ ID NO: 1597)

5'-ACUGUAUUCUGUAUGAAUGCAUGGCAU-3'  (SEQ ID NO: 3902)
                3'-UGACAUAAGACAUACUUACGUACCGUA-5'  (SEQ ID NO: 1022)
CKAP5-6658 Target:5'-ACTGTATTCTGTATGAATGCATGGCAT-3' (SEQ ID NO: 1598)

5'-UGUAUUCUGUAUGAAUGCAUGGCAUGA-3'  (SEQ ID NO: 3903)
                3'-ACAUAAGACAUACUUACGUACCGUACU-5'  (SEQ ID NO: 1023)
CKAP5-6660 Target:5'-TGTATTCTGTATGAATGCATGGCATGA-3' (SEQ ID NO: 1599)

5'-UAUUCUGUAUGAAUGCAUGGCAUGAUA-3'  (SEQ ID NO: 3904)
                3'-AUAAGACAUACUUACGUACCGUACUAU-5'  (SEQ ID NO: 1024)
CKAP5-6662 Target:5'-TATTCTGTATGAATGCATGGCATGATA-3' (SEQ ID NO: 1600)

5'-UUCUGUAUGAAUGCAUGGCAUGAUACA-3'  (SEQ ID NO: 3905)
                3'-AAGACAUACUUACGUACCGUACUAUGU-5'  (SEQ ID NO: 1025)
CKAP5-6664 Target:5'-TTCTGTATGAATGCATGGCATGATACA-3' (SEQ ID NO: 1601)

5'-CUGUAUGAAUGCAUGGCAUGAUACAAC-3'  (SEQ ID NO: 3906)
                3'-GACAUACUUACGUACCGUACUAUGUUG-5'  (SEQ ID NO: 1026)
CKAP5-6666 Target:5'-CTGTATGAATGCATGGCATGATACAAC-3' (SEQ ID NO: 1602)

5'-UCUUUUAUAAAUAAAGUUUGCAUUAAC-3'  (SEQ ID NO: 3907)
                3'-AGAAAAUAUUUAUUUCAAACGUAAUUG-5'  (SEQ ID NO: 1027)
CKAP5-6704 Target:5'-TCTTTTATAAATAAAGTTTGCATTAAC-3' (SEQ ID NO: 1603)

5'-UUUUAUAAAUAAAGUUUGCAUUAACUA-3'  (SEQ ID NO: 3908)
                3'-AAAAUAUUUAUUUCAAACGUAAUUGAU-5'  (SEQ ID NO: 1028)
CKAP5-6706 Target:5'-TTTTATAAATAAAGTTTGCATTAACTA-3' (SEQ ID NO: 1604)
```

TABLE 6-continued

Selected Human Anti-CKAP5 "Blunt/Blunt" DsiRNAs

```
                   5'-UUAUAAAUAAAGUUUGCAUUAACUAUA-3'    (SEQ ID NO: 3909)
                   3'-AAUAUUUAUUUCAAACGUAAUUGAUAUA-5'   (SEQ ID NO: 1029)
CKAP5-6708 Target: 5'-TTATAAATAAAGTTTGCATTAACTATA-3'    (SEQ ID NO: 1605)

5'-AUAAAUAAAGUUUGCAUUAACUAUACC-3'    (SEQ ID NO: 3910)
                   3'-UAUUUAUUUCAAACGUAAUUGAUAUGG-5'    (SEQ ID NO: 1030)
CKAP5-6710 Target: 5'-ATAAATAAAGTTTGCATTAACTATACC-3'    (SEQ ID NO: 1606)

5'-AAAUAAAGUUUGCAUUAACUAUACCUG-3'    (SEQ ID NO: 3911)
                   3'-UUUAUUUCAAACGUAAUUGAUAUGGAC-5'    (SEQ ID NO: 1031)
CKAP5-6712 Target: 5'-AAATAAAGTTTGCATTAACTATACCTG-3'    (SEQ ID NO: 1607)

5'-AUAAAGUUUGCAUUAACUAUACCUGAC-3'    (SEQ ID NO: 3912)
                   3'-UAUUUCAAACGUAAUUGAUAUGGACUG-5'    (SEQ ID NO: 1032)
CKAP5-6714 Target: 5'-ATAAAGTTTGCATTAACTATACCTGAC-3'    (SEQ ID NO: 1608)

5'-CCCAGCUGAGGAAAUACUCUUAAUUCU-3'    (SEQ ID NO: 3913)
                   3'-GGGUCGACUCCUUUAUGAGAAUUAAGA-5'    (SEQ ID NO: 1033)
CKAP5-106 Target:  5'-CCCAGCTGAGGAAATACTCTTAATTCT-3'    (SEQ ID NO: 1609)

5'-GGUUGAAACUGCCAGUUGAUCAGAAAU-3'    (SEQ ID NO: 3914)
                   3'-CCAACUUUGACGGUCAACUAGUCUUUA-5'    (SEQ ID NO: 1034)
CKAP5-172 Target:  5'-GGTTGAAACTGCCAGTTGATCAGAAAT-3'    (SEQ ID NO: 1610)

5'-CUGCCAGUUGAUCAGAAAUGUGAACAC-3'    (SEQ ID NO: 3915)
                   3'-GACGGUCAACUAGUCUUUACACUUGUG-5'    (SEQ ID NO: 1035)
CKAP5-180 Target:  5'-CTGCCAGTTGATCAGAAATGTGAACAC-3'    (SEQ ID NO: 1611)

5'-UGGAAAGCAAGGUUAAGUGGGUAUGAA-3'    (SEQ ID NO: 3916)
                   3'-ACCUUUCGUUCCAAUUCACCCAUACUU-5'    (SEQ ID NO: 1036)
CKAP5-213 Target:  5'-TGGAAAGCAAGGTTAAGTGGGTATGAA-3'    (SEQ ID NO: 1612)

5'-CCCAGAGUGGUCCAAAUUUUUAGGAUU-3'    (SEQ ID NO: 3917)
                   3'-GGGUCUCACCAGGUUUAAAAAUCCUAA-5'    (SEQ ID NO: 1037)
CKAP5-281 Target:  5'-CCCAGAGTGGTCCAAATTTTTAGGATT-3'    (SEQ ID NO: 1613)

5'-CAGUGGUUCAAUUGAAAGGAUUAGAAG-3'    (SEQ ID NO: 3918)
                   3'-GUCACCAAGUUAACUUUCCUAAUCUUC-5'    (SEQ ID NO: 1038)
CKAP5-337 Target:  5'-CAGTGGTTCAATTGAAAGGATTAGAAG-3'    (SEQ ID NO: 1614)

5'-AGGAUUAGAAGCUGCACUUGUUUAUGU-3'    (SEQ ID NO: 3919)
                   3'-UCCUAAUCUUCGACGUGAACAAAUACA-5'    (SEQ ID NO: 1039)
CKAP5-353 Target:  5'-AGGATTAGAAGCTGCACTTGTTTATGT-3'    (SEQ ID NO: 1615)

5'-AGCUGCACUUGUUUAUGUUGAAAAUGC-3'    (SEQ ID NO: 3920)
                   3'-UCGACGUGAACAAAUACAACUUUUACG-5'    (SEQ ID NO: 1040)
CKAP5-362 Target:  5'-AGCTGCACTTGTTTATGTTGAAAATGC-3'    (SEQ ID NO: 1616)

5'-AGCAGGAAAAACCACAGGAGAAGUUGU-3'    (SEQ ID NO: 3921)
                   3'-UCGUCCUUUUUGGUGUCCUCUUCAACA-5'    (SEQ ID NO: 1041)
CKAP5-395 Target:  5'-AGCAGGAAAAACCACAGGAGAAGTTGT-3'    (SEQ ID NO: 1617)

5'-GUCAGGUGUUGUAAGUAAGGUGUUCAA-3'    (SEQ ID NO: 3922)
                   3'-CAGUCCACAACAUUCAUUCCACAAGUU-5'    (SEQ ID NO: 1042)
CKAP5-422 Target:  5'-GTCAGGTGTTGTAAGTAAGGTGTTCAA-3'    (SEQ ID NO: 1618)

5'-GUGUUGUAAGUAAGGUGUUCAAUCAAC-3'    (SEQ ID NO: 3923)
                   3'-CACAACAUUCAUUCCACAAGUUAGUUG-5'    (SEQ ID NO: 1043)
CKAP5-427 Target:  5'-GTGTTGTAAGTAAGGTGTTCAATCAAC-3'    (SEQ ID NO: 1619)

5'-GUUCAAUCAACCUAAAGCUAAAGCCAA-3'    (SEQ ID NO: 3924)
                   3'-CAAGUUAGUUGGAUUUCGAUUUCGGUU-5'    (SEQ ID NO: 1044)
CKAP5-443 Target:  5'-GTTCAATCAACCTAAAGCTAAAGCCAA-3'    (SEQ ID NO: 1620)

5'-CUCCUGAAAGGCUUGGACAAUAAGAAU-3'    (SEQ ID NO: 3925)
                   3'-GAGGACUUUCCGAACCUGUUAUUCUUA-5'    (SEQ ID NO: 1045)
CKAP5-537 Target:  5'-CTCCTGAAAGGCTTGGACAATAAGAAT-3'    (SEQ ID NO: 1621)

5'-UUAAGCCAAUUAUCAAAGUGUUGCCAA-3'    (SEQ ID NO: 3926)
                   3'-AAUUCGGUUAAUAGUUUCACAACGGUU-5'    (SEQ ID NO: 1046)
CKAP5-637 Target:  5'-TTAAGCCAATTATCAAAGTGTTGCCAA-3'    (SEQ ID NO: 1622)

5'-UCAAAGUGUUGCCAAAACUCUUUGAGU-3'    (SEQ ID NO: 3927)
                   3'-AGUUUCACAACGGUUUUGAGAAACUCA-5'    (SEQ ID NO: 1047)
CKAP5-649 Target:  5'-TCAAAGTGTTGCCAAAACTCTTTGAGT-3'    (SEQ ID NO: 1623)
```

TABLE 6-continued

Selected Human Anti-CKAP5 "Blunt/Blunt" DsiRNAs

```
                 5'-GCCAAAACUCUUUGAGUCUCGAGAGAA-3'   (SEQ ID NO: 3928)
                 3'-CGGUUUUGAGAAACUCAGAGCUCUCUU-5'   (SEQ ID NO: 1048)
CKAP5-659 Target: 5'-GCCAAAACTCTTTGAGTCTCGAGAGAA-3'  (SEQ ID NO: 1624)

5'-GGCUGUUCGAGAUGAAGCCAAACUAAU-3'   (SEQ ID NO: 3929)
                 3'-CCGACAAGCUCUACUUCGGUUUGAUUA-5'   (SEQ ID NO: 1049)
CKAP5-686 Target: 5'-GGCTGTTCGAGATGAAGCCAAACTAAT-3'  (SEQ ID NO: 1625)

5'-CCCAUUACAAAAUAUAAACUCUGUUCA-3'   (SEQ ID NO: 3930)
                 3'-GGGUAAUGUUUUAUAUUUGAGACAAGU-5'   (SEQ ID NO: 1050)
CKAP5-755 Target: 5'-CCCATTACAAAATATAAACTCTGTTCA-3'  (SEQ ID NO: 1626)

5'-ACAAAAUAUAAACUCUGUUCAGUUGAA-3'   (SEQ ID NO: 3931)
                 3'-UGUUUUAUAUUUGAGACAAGUCAACUU-5'   (SEQ ID NO: 1051)
CKAP5-761 Target: 5'-ACAAAATATAAACTCTGTTCAGTTGAA-3'  (SEQ ID NO: 1627)

5'-AUAUAAACUCUGUUCAGUUGAAAGAAC-3'   (SEQ ID NO: 3932)
                 3'-UAUAUUUGAGACAAGUCAACUUUCUUG-5'   (SEQ ID NO: 1052)
CKAP5-766 Target: 5'-ATATAAACTCTGTTCAGTTGAAAGAAC-3'  (SEQ ID NO: 1628)

5'-CUCUGUUCAGUUGAAAGAACUAGAAGA-3'   (SEQ ID NO: 3933)
                 3'-GAGACAAGUCAACUUUCUUGAUCUUCU-5'   (SEQ ID NO: 1053)
CKAP5-773 Target: 5'-CTCTGTTCAGTTGAAAGAACTAGAAGA-3'  (SEQ ID NO: 1629)

5'-GUGAUGAGGUGCCACAAAUAGAUGCUU-3'   (SEQ ID NO: 3934)
                 3'-CACUACUCCACGGUGUUUAUCUACGAA-5'   (SEQ ID NO: 1054)
CKAP5-928 Target: 5'-GTGATGAGGTGCCACAAATAGATGCTT-3'  (SEQ ID NO: 1630)

5'-ACAAAUAGAUGCUUAUGAGCUUUUAGA-3'   (SEQ ID NO: 3935)
                 3'-UGUUUAUCUACGAAUACUCGAAAAUCU-5'   (SEQ ID NO: 1055)
CKAP5-941 Target: 5'-ACAAATAGATGCTTATGAGCTTTTAGA-3'  (SEQ ID NO: 1631)

5'-UUAUGAGCUUUUAGAAGCUGUAGAAAU-3'   (SEQ ID NO: 3936)
                 3'-AAUACUCGAAAAUCUUCGACAUCUUUA-5'   (SEQ ID NO: 1056)
CKAP5-953 Target: 5'-TTATGAGCTTTTAGAAGCTGTAGAAAT-3'  (SEQ ID NO: 1632)

5'-GGCCCUGGAGUCUGUAGAAGUACUAAU-3'   (SEQ ID NO: 3937)
                 3'-CCGGGACCUCAGACAUCUUCAUGAUUA-5'   (SEQ ID NO: 1057)
CKAP5-1046 Target: 5'-GGCCCTGGAGTCTGTAGAAGTACTAAT-3' (SEQ ID NO: 1633)

5'-UGGAGUCUGUAGAAGUACUAAUAAAAA-3'   (SEQ ID NO: 3938)
                 3'-ACCUCAGACAUCUUCAUGAUUAUUUUU-5'   (SEQ ID NO: 1058)
CKAP5-1051 Target: 5'-TGGAGTCTGTAGAAGTACTAATAAAAA-3' (SEQ ID NO: 1634)

5'-UGCAGAUUUAGUAAAAGCAUUAAAGAA-3'   (SEQ ID NO: 3939)
                 3'-ACGUCUAAAUCAUUUUCGUAAUUUCUU-5'   (SEQ ID NO: 1059)
CKAP5-1103 Target: 5'-TGCAGATTTAGTAAAAGCATTAAAGAA-3' (SEQ ID NO: 1635)

5'-GUAAAAGCAUUAAAGAAGGUUGUUGGA-3'   (SEQ ID NO: 3940)
                 3'-CAUUUUCGUAAUUUCUUCCAACAACCU-5'   (SEQ ID NO: 1060)
CKAP5-1113 Target: 5'-GTAAAAGCATTAAAGAAGGTTGTTGGA-3' (SEQ ID NO: 1636)

5'-AGCAUUAAAGAAGGUUGUUGGAAAGGA-3'   (SEQ ID NO: 3941)
                 3'-UCGUAAUUUCUUCCAACAACCUUUCCU-5'   (SEQ ID NO: 1061)
CKAP5-1118 Target: 5'-AGCATTAAAGAAGGTTGTTGGAAAGGA-3' (SEQ ID NO: 1637)

5'-AAGAAGGUUGUUGGAAAGGACACCAAU-3'   (SEQ ID NO: 3942)
                 3'-UUCUUCCAACAACCUUUCCUGUGGUUA-5'   (SEQ ID NO: 1062)
CKAP5-1125 Target: 5'-AAGAAGGTTGTTGGAAAGGACACCAAT-3' (SEQ ID NO: 1638)

5'-AAGGAAGAAAUUUGGACAAUAUGCAGG-3'   (SEQ ID NO: 3943)
                 3'-UUCCUUCUUUAAACCUGUUAUACGUCC-5'   (SEQ ID NO: 1063)
CKAP5-1205 Target: 5'-AAGGAAGAAATTTGGACAATATGCAGG-3' (SEQ ID NO: 1639)

5'-CAGUGAGGAUGUUUUAGCAGUAAUGGA-3'   (SEQ ID NO: 3944)
                 3'-GUCACUCCUACAAAAUCGUCAUUACCU-5'   (SEQ ID NO: 1064)
CKAP5-1343 Target: 5'-CAGTGAGGATGTTTTAGCAGTAATGGA-3' (SEQ ID NO: 1640)

5'-AUGUUUUAGCAGUAAUGGAUAAUAAAA-3'   (SEQ ID NO: 3945)
                 3'-UACAAAAUCGUCAUUACCUAUUAUUUU-5'   (SEQ ID NO: 1065)
CKAP5-1351 Target: 5'-ATGTTTTAGCAGTAATGGATAATAAAA-3' (SEQ ID NO: 1641)

5'-AUCAAGCAGCAGACAUCUCUUUUUAUU-3'   (SEQ ID NO: 3946)
                 3'-UAGUUCGUCGUCUGUAGAGAAAAAUAA-5'   (SEQ ID NO: 1066)
CKAP5-1386 Target: 5'-ATCAAGCAGCAGACATCTCTTTTTATT-3' (SEQ ID NO: 1642)
```

TABLE 6-continued

Selected Human Anti-CKAP5 "Blunt/Blunt" DsiRNAs

```
                5'-CAGACAUCUCUUUUUAUUGCAAGAAGU-3'   (SEQ ID NO: 3947)
                3'-GUCUGUAGAGAAAAAUAACGUUCUUCA-5'   (SEQ ID NO: 1067)
CKAP5-1395 Target:5'-CAGACATCTCTTTTTATTGCAAGAAGT-3' (SEQ ID NO: 1643)

5'-AGUCAGAGAUGCCGCAUUUGAAGCAUU-3'   (SEQ ID NO: 3948)
                3'-UCAGUCUCUACGGCGUAAACUUCGUAA-5'   (SEQ ID NO: 1068)
CKAP5-1514 Target:5'-AGTCAGAGATGCCGCATTTGAAGCATT-3' (SEQ ID NO: 1644)

5'-AGCAUUGGGUACUGCUUUGAAGGUGGU-3'   (SEQ ID NO: 3949)
                3'-UCGUAACCCAUGACGAAACUUCCACCA-5'   (SEQ ID NO: 1069)
CKAP5-1535 Target:5'-AGCATTGGGTACTGCTTTGAAGGTGGT-3' (SEQ ID NO: 1645)

5'-AUGUGGACAAACUCAAGCUUGAUAAGA-3'   (SEQ ID NO: 3950)
                3'-UACACCUGUUUGAGUUCGAACUAUUCU-5'   (SEQ ID NO: 1070)
CKAP5-1594 Target:5'-ATGTGGACAAACTCAAGCTTGATAAGA-3' (SEQ ID NO: 1646)

5'-CAAAGAAUGUUCAGAAAAGGUAGAACU-3'   (SEQ ID NO: 3951)
                3'-GUUUCUUACAAGUCUUUUCCAUCUUGA-5'   (SEQ ID NO: 1071)
CKAP5-1622 Target:5'-CAAAGAATGTTCAGAAAAGGTAGAACT-3' (SEQ ID NO: 1647)

5'-GUUCAGAAAAGGUAGAACUGAUACAUG-3'   (SEQ ID NO: 3952)
                3'-CAAGUCUUUUCCAUCUUGACUAUGUAC-5'   (SEQ ID NO: 1072)
CKAP5-1630 Target:5'-GTTCAGAAAAGGTAGAACTGATACATG-3' (SEQ ID NO: 1648)

5'-AAGGUAGAACUGAUACAUGGUAAGAAA-3'   (SEQ ID NO: 3953)
                3'-UUCCAUCUUGACUAUGUACCAUUCUUU-5'   (SEQ ID NO: 1073)
CKAP5-1638 Target:5'-AAGGTAGAACTGATACATGGTAAGAAA-3' (SEQ ID NO: 1649)

5'-CGCAGGGAAUACUGGAACCAAGAACAA-3'   (SEQ ID NO: 3954)
                3'-GCGUCCCUUAUGACCUUGGUUCUUGUU-5'   (SEQ ID NO: 1074)
CKAP5-1847 Target:5'-CGCAGGGAATACTGGAACCAAGAACAA-3' (SEQ ID NO: 1650)

5'-AGCCUGAGCUCUCGAUAGAAGUAUGUG-3'   (SEQ ID NO: 3955)
                3'-UCGGACUCGAGAGCUAUCUUCAUACAC-5'   (SEQ ID NO: 1075)
CKAP5-1903 Target:5'-AGCCTGAGCTCTCGATAGAAGTATGTG-3' (SEQ ID NO: 1651)

5'-CUCGAUAGAAGUAUGUGAAGAAAAAGC-3'   (SEQ ID NO: 3956)
                3'-GAGCUAUCUUCAUACACUUCUUUUUCG-5'   (SEQ ID NO: 1076)
CKAP5-1913 Target:5'-CTCGATAGAAGTATGTGAAGAAAAAGC-3' (SEQ ID NO: 1652)

5'-UUCUUGACAGCAGUAACUGGAAAGAAA-3'   (SEQ ID NO: 3957)
                3'-AAGAACUGUCGUCAUUGACCUUUCUUU-5'   (SEQ ID NO: 1077)
CKAP5-1972 Target:5'-TTCTTGACAGCAGTAACTGGAAAGAAA-3' (SEQ ID NO: 1653)

5'-GAGCUAAUGGACCGAACUGAAAUGCCA-3'   (SEQ ID NO: 3958)
                3'-CUCGAUUACCUGGCUUGACUUUACGGU-5'   (SEQ ID NO: 1078)
CKAP5-2034 Target:5'-GAGCTAATGGACCGAACTGAAATGCCA-3' (SEQ ID NO: 1654)

5'-CAUUAGUGAGGAUGCUAGCCAAGAAAC-3'   (SEQ ID NO: 3959)
                3'-GUAAUCACUCCUACGAUCGGUUCUUUG-5'   (SEQ ID NO: 1079)
CKAP5-2068 Target:5'-CATTAGTGAGGATGCTAGCCAAGAAAC-3' (SEQ ID NO: 1655)

5'-UAGCCAAGAAACCUGGAUGGAAAGAAA-3'   (SEQ ID NO: 3960)
                3'-AUCGGUUCUUUGGACCUACCUUUCUUU-5'   (SEQ ID NO: 1080)
CKAP5-2083 Target:5'-TAGCCAAGAAACCTGGATGGAAAGAAA-3' (SEQ ID NO: 1656)

5'-AAGAAACCUGGAUGGAAAGAAACUAAU-3'   (SEQ ID NO: 3961)
                3'-UUCUUUGGACCUACCUUUCUUUGAUUA-5'   (SEQ ID NO: 1081)
CKAP5-2088 Target:5'-AAGAAACCTGGATGGAAAGAAACTAAT-3' (SEQ ID NO: 1657)

5'-AGGUGAUGCAAAUGAAGCUUCAUAUAG-3'   (SEQ ID NO: 3962)
                3'-UCCACUACGUUUACUUCGAAGUAUAUC-5'   (SEQ ID NO: 1082)
CKAP5-2119 Target:5'-AGGTGATGCAAATGAAGCTTCATATAG-3' (SEQ ID NO: 1658)

5'-CAAAACGUCAGCUCAGGUUGUAUUAGA-3'   (SEQ ID NO: 3963)
                3'-GUUUUGCAGUCGAGUCCAACAUAAUCU-5'   (SEQ ID NO: 1083)
CKAP5-2177 Target:5'-CAAAACGTCAGCTCAGGTTGTATTAGA-3' (SEQ ID NO: 1659)

5'-UGCAAAAGAAGCUAUGACAGCAAUAGC-3'   (SEQ ID NO: 3964)
                3'-ACGUUUUCUUCGAUACUGUCGUUAUCG-5'   (SEQ ID NO: 1084)
CKAP5-2246 Target:5'-TGCAAAAGAAGCTATGACAGCAATAGC-3' (SEQ ID NO: 1660)

5'-GACAGCAAUAGCCGAAGCCUGUAUGUU-3'   (SEQ ID NO: 3965)
                3'-CUGUCGUUAUCGGCUUCGGACAUACAA-5'   (SEQ ID NO: 1085)
CKAP5-2261 Target:5'-GACAGCAATAGCCGAAGCCTGTATGTT-3' (SEQ ID NO: 1661)
```

TABLE 6-continued

Selected Human Anti-CKAP5 "Blunt/Blunt" DsiRNAs

```
                      5'-CCGAAGCCUGUAUGUUACCAUGGACUG-3'   (SEQ ID NO: 3966)
                      3'-GGCUUCGGACAUACAAUGGUACCUGAC-5'   (SEQ ID NO: 1086)
CKAP5-2272 Target: 5'-CCGAAGCCTGTATGTTACCATGGACTG-3'     (SEQ ID NO: 1662)

5'-CAAAAAUCAGUCAGAAACUCUGAAUUG-3'   (SEQ ID NO: 3967)
                      3'-GUUUUUAGUCAGUCUUUGAGACUUAAC-5'   (SEQ ID NO: 1087)
CKAP5-2339 Target: 5'-CAAAAATCAGTCAGAAACTCTGAATTG-3'     (SEQ ID NO: 1663)

5'-AAAGCUUUCAUUAGCAAUGUGAAGACA-3'   (SEQ ID NO: 3968)
                      3'-UUUCGAAAGUAAUCGUUACACUUCUGU-5'   (SEQ ID NO: 1088)
CKAP5-2412 Target: 5'-AAAGCTTTCATTAGCAATGTGAAGACA-3'     (SEQ ID NO: 1664)

5'-UUGAGAAGAUGCAGGGACAAAGUCCAC-3'   (SEQ ID NO: 3969)
                      3'-AACUCUUCUACGUCCCUGUUUCAGGUG-5'   (SEQ ID NO: 1089)
CKAP5-2578 Target: 5'-TTGAGAAGATGCAGGGACAAAGTCCAC-3'     (SEQ ID NO: 1665)

5'-GAGCAAUGAUGUCGUUGAUCUUUUGCC-3'   (SEQ ID NO: 3970)
                      3'-CUCGUUACUACAGCAACUAGAAAACGG-5'   (SEQ ID NO: 1090)
CKAP5-2684 Target: 5'-GAGCAATGATGTCGTTGATCTTTTGCC-3'     (SEQ ID NO: 1666)

5'-AUGAAGUGGCAGGUAUUAUUAAUGACG-3'   (SEQ ID NO: 3971)
                      3'-UACUUCACCGUCCAUAAUAAUUACUGC-5'   (SEQ ID NO: 1091)
CKAP5-2797 Target: 5'-ATGAAGTGGCAGGTATTATTAATGACG-3'     (SEQ ID NO: 1667)

5'-CUGCCUUGAAGGGUCGACUCAAUGAUU-3'   (SEQ ID NO: 3972)
                      3'-GACGGAACUUCCCAGCUGAGUUACUAA-5'   (SEQ ID NO: 1092)
CKAP5-2860 Target: 5'-CTGCCTTGAAGGGTCGACTCAATGATT-3'     (SEQ ID NO: 1668)

5'-UUGAAGGGUCGACUCAAUGAUUCAAAU-3'   (SEQ ID NO: 3973)
                      3'-AACUUCCCAGCUGAGUUACUAAGUUUA-5'   (SEQ ID NO: 1093)
CKAP5-2865 Target: 5'-TTGAAGGGTCGACTCAATGATTCAAAT-3'     (SEQ ID NO: 1669)

5'-UCGACUCAAUGAUUCAAAUAAAAUCUU-3'   (SEQ ID NO: 3974)
                      3'-AGCUGAGUUACUAAGUUUAUUUUAGAA-5'   (SEQ ID NO: 1094)
CKAP5-2873 Target: 5'-TCGACTCAATGATTCAAATAAAATCTT-3'     (SEQ ID NO: 1670)

5'-CAAUGAUUCAAAUAAAAUCUUGGUACA-3'   (SEQ ID NO: 3975)
                      3'-GUUACUAAGUUUAUUUUAGAACCAUGU-5'   (SEQ ID NO: 1095)
CKAP5-2879 Target: 5'-CAATGATTCAAATAAAATCTTGGTACA-3'     (SEQ ID NO: 1671)

5'-GUAGCCAUGGGCCCAAAUAUUAAGCAA-3'   (SEQ ID NO: 3976)
                      3'-CAUCGGUACCCGGGUUUAUAAUUCGUU-5'   (SEQ ID NO: 1096)
CKAP5-2937 Target: 5'-GTAGCCATGGGCCCAAATATTAAGCAA-3'     (SEQ ID NO: 1672)

5'-CCAAAUAUUAAGCAACAUGUAAAAAAU-3'   (SEQ ID NO: 3977)
                      3'-GGUUUAUAAUUCGUUGUACAUUUUUUA-5'   (SEQ ID NO: 1097)
CKAP5-2949 Target: 5'-CCAAATATTAAGCAACATGTAAAAAAT-3'     (SEQ ID NO: 1673)

5'-GUCCUUGGAGACAGCAAGAACAAUGUU-3'   (SEQ ID NO: 3978)
                      3'-CAGGAACCUCUGUCGUUCUUGUUACAA-5'   (SEQ ID NO: 1098)
CKAP5-2997 Target: 5'-GTCCTTGGAGACAGCAAGAACAATGTT-3'     (SEQ ID NO: 1674)

5'-UGGAGACAGCAAGAACAAUGUUCGAGC-3'   (SEQ ID NO: 3979)
                      3'-ACCUCUGUCGUUCUUGUUACAAGCUCG-5'   (SEQ ID NO: 1099)
CKAP5-3002 Target: 5'-TGGAGACAGCAAGAACAATGTTCGAGC-3'     (SEQ ID NO: 1675)

5'-UUCAUGAUGCAUUUAGGAUAUGAAAAA-3'   (SEQ ID NO: 3980)
                      3'-AAGUACUACGUAAAUCCUAUACUUUUU-5'   (SEQ ID NO: 1100)
CKAP5-3285 Target: 5'-TTCATGATGCATTTAGGATATGAAAAA-3'     (SEQ ID NO: 1676)

5'-UGCUAGAGAAAGCCAAAGUUAACAUGC-3'   (SEQ ID NO: 3981)
                      3'-ACGAUCUCUUUCGGUUUCAAUUGUACG-5'   (SEQ ID NO: 1101)
CKAP5-3367 Target: 5'-TGCTAGAGAAAGCCAAAGTTAACATGC-3'     (SEQ ID NO: 1677)

5'-AAGGGAAGAAGAUGCCAAGCAAAACCA-3'   (SEQ ID NO: 3982)
                      3'-UUCCCUUCUUCUACGGUUCGUUUUGGU-5'   (SEQ ID NO: 1102)
CKAP5-3571 Target: 5'-AAGGGAAGAAGATGCCAAGCAAAACCA-3'     (SEQ ID NO: 1678)

5'-UGGAAAAGAGCAAAGGAUGAAAGAUGA-3'   (SEQ ID NO: 3983)
                      3'-ACCUUUUCUCGUUUCCUACUUUCUACU-5'   (SEQ ID NO: 1103)
CKAP5-3650 Target: 5'-TGGAAAAGAGCAAAGGATGAAAGATGA-3'     (SEQ ID NO: 1679)

5'-AAGAGCAAAGGAUGAAAGAUGAAAAAG-3'   (SEQ ID NO: 3984)
                      3'-UUCUCGUUUCCUACUUUCUACUUUUUC-5'   (SEQ ID NO: 1104)
CKAP5-3655 Target: 5'-AAGAGCAAAGGATGAAAGATGAAAAAG-3'     (SEQ ID NO: 1680)
```

TABLE 6-continued

Selected Human Anti-CKAP5 "Blunt/Blunt" DsiRNAs

|  |  |  |
|---|---|---|
| CKAP5-3716 Target: | 5'-ACGGGAUGAAUACAUUGAGCAACUAAA-3'<br>3'-UGCCCUACUUAUGUAACUCGUUGAUUU-5'<br>5'-ACGGGATGAATACATTGAGCAACTAAA-3' | (SEQ ID NO: 3985)<br>(SEQ ID NO: 1105)<br>(SEQ ID NO: 1681) |
| CKAP5-3721 Target: | 5'-AUGAAUACAUUGAGCAACUAAAGACUC-3'<br>3'-UACUUAUGUAACUCGUUGAUUUCUGAG-5'<br>5'-ATGAATACATTGAGCAACTAAAGACTC-3' | (SEQ ID NO: 3986)<br>(SEQ ID NO: 1106)<br>(SEQ ID NO: 1682) |
| CKAP5-3890 Target: | 5'-AAAGUGGCUUACCCUGAGGUUUUUUGA-3'<br>3'-UUUCACCGAAUGGGACUCCAAAAAACU-5'<br>5'-AAAGTGGCTTACCCTGAGGTTTTTTGA-3' | (SEQ ID NO: 3987)<br>(SEQ ID NO: 1107)<br>(SEQ ID NO: 1683) |
| CKAP5-3900 Target: | 5'-ACCCUGAGGUUUUUUGACACCAAUACA-3'<br>3'-UGGGACUCCAAAAAACUGUGGUUAUGU-5'<br>5'-ACCCTGAGGTTTTTTGACACCAATACA-3' | (SEQ ID NO: 3988)<br>(SEQ ID NO: 1108)<br>(SEQ ID NO: 1684) |
| CKAP5-3918 Target: | 5'-ACCAAUACAAGCGUCCUGAUGAAAGCA-3'<br>3'-UGGUUAUGUUCGCAGGACUACUUUCGU-5'<br>5'-ACCAATACAAGCGTCCTGATGAAAGCA-3' | (SEQ ID NO: 3989)<br>(SEQ ID NO: 1109)<br>(SEQ ID NO: 1685) |
| CKAP5-3928 Target: | 5'-GCGUCCUGAUGAAAGCACUAGAAUAUU-3'<br>3'-CGCAGGACUACUUUCGUGAUCUUAUAA-5'<br>5'-GCGTCCTGATGAAAGCACTAGAATATT-3' | (SEQ ID NO: 3990)<br>(SEQ ID NO: 1110)<br>(SEQ ID NO: 1686) |
| CKAP5-3934 Target: | 5'-UGAUGAAAGCACUAGAAUAUUUAAAAU-3'<br>3'-ACUACUUUCGUGAUCUUAUAAAUUUUA-5'<br>5'-TGATGAAAGCACTAGAATATTTAAAAT-3' | (SEQ ID NO: 3991)<br>(SEQ ID NO: 1111)<br>(SEQ ID NO: 1687) |
| CKAP5-4367 Target: | 5'-UGGAAAUCUUUCUGAAAAGGAUAUGAG-3'<br>3'-ACCUUUAGAAAGACUUUUCCUAUACUC-5'<br>5'-TGGAAATCTTTCTGAAAAGGATATGAG-3' | (SEQ ID NO: 3992)<br>(SEQ ID NO: 1112)<br>(SEQ ID NO: 1688) |
| CKAP5-4378 Target: | 5'-CUGAAAAGGAUAUGAGCAUGCUCGAGG-3'<br>3'-GACUUUUCCUAUACUCGUACGAGCUCC-5'<br>5'-CTGAAAAGGATATGAGCATGCTCGAGG-3' | (SEQ ID NO: 3993)<br>(SEQ ID NO: 1113)<br>(SEQ ID NO: 1689) |
| CKAP5-4487 Target: | 5'-AAGCUCCAAUGCCAACAUGUUACGCAA-3'<br>3'-UUCGAGGUUACGGUUGUACAAUGCGUU-5'<br>5'-AAGCTCCAATGCCAACATGTTACGCAA-3' | (SEQ ID NO: 3994)<br>(SEQ ID NO: 1114)<br>(SEQ ID NO: 1690) |
| CKAP5-4492 Target: | 5'-CCAAUGCCAACAUGUUACGCAAGGGAC-3'<br>3'-GGUUACGGUUGUACAAUGCGUUCCCUG-5'<br>5'-CCAATGCCAACATGTTACGCAAGGGAC-3' | (SEQ ID NO: 3995)<br>(SEQ ID NO: 1115)<br>(SEQ ID NO: 1691) |
| CKAP5-4649 Target: | 5'-AUGUGAAAUGCCAGAACUUGUUCAGCA-3'<br>3'-UACACUUUACGGUCUUGAACAAGUCGU-5'<br>5'-ATGTGAAATGCCAGAACTTGTTCAGCA-3' | (SEQ ID NO: 3996)<br>(SEQ ID NO: 1116)<br>(SEQ ID NO: 1692) |
| CKAP5-4658 Target: | 5'-GCCAGAACUUGUUCAGCACAAACUGGA-3'<br>3'-CGGUCUUGAACAAGUCGUGUUUGACCU-5'<br>5'-GCCAGAACTTGTTCAGCACAAACTGGA-3' | (SEQ ID NO: 3997)<br>(SEQ ID NO: 1117)<br>(SEQ ID NO: 1693) |
| CKAP5-4673 Target: | 5'-GCACAAACUGGAUGACAUUUUUGAGCC-3'<br>3'-CGUGUUUGACCUACUGUAAAAACUCGG-5'<br>5'-GCACAAACTGGATGACATTTTTGAGCC-3' | (SEQ ID NO: 3998)<br>(SEQ ID NO: 1118)<br>(SEQ ID NO: 1694) |
| CKAP5-4681 Target: | 5'-UGGAUGACAUUUUUGAGCCAGUCCUUA-3'<br>3'-ACCUACUGUAAAAACUCGGUCAGGAAU-5'<br>5'-TGGATGACATTTTTGAGCCAGTCCTTA-3' | (SEQ ID NO: 3999)<br>(SEQ ID NO: 1119)<br>(SEQ ID NO: 1695) |
| CKAP5-4686 Target: | 5'-GACAUUUUUGAGCCAGUCCUUAUUCCU-3'<br>3'-CUGUAAAAACUCGGUCAGGAAUAAGGA-5'<br>5'-GACATTTTTGAGCCAGTCCTTATTCCT-3' | (SEQ ID NO: 4000)<br>(SEQ ID NO: 1120)<br>(SEQ ID NO: 1696) |
| CKAP5-4693 Target: | 5'-UUGAGCCAGUCCUUAUUCCUGAACCCA-3'<br>3'-AACUCGGUCAGGAAUAAGGACUUGGGU-5'<br>5'-TTGAGCCAGTCCTTATTCCTGAACCCA-3' | (SEQ ID NO: 4001)<br>(SEQ ID NO: 1121)<br>(SEQ ID NO: 1697) |
| CKAP5-5057 Target: | 5'-CACUGGAGUACUAAAAGACCUAAUGCA-3'<br>3'-GUGACCUCAUGAUUUUCUGGAUUACGU-5'<br>5'-CACTGGAGTACTAAAAGACCTAATGCA-3' | (SEQ ID NO: 4002)<br>(SEQ ID NO: 1122)<br>(SEQ ID NO: 1698) |
| CKAP5-5167 Target: | 5'-UGGUGAAGGUUCUGGAGAAGUCAGACC-3'<br>3'-ACCACUUCCAAGACCUCUUCAGUCUGG-5'<br>5'-TGGTGAAGGTTCTGGAGAAGTCAGACC-3' | (SEQ ID NO: 4003)<br>(SEQ ID NO: 1123)<br>(SEQ ID NO: 1699) |

TABLE 6-continued

Selected Human Anti-CKAP5 "Blunt/Blunt" DsiRNAs

```
                      5'-AUCCUGAGUGCCCUACUUGUUUUGCUC-3'   (SEQ ID NO: 4004)
                      3'-UAGGACUCACGGGAUGAACAAAACGAG-5'   (SEQ ID NO: 1124)
CKAP5-5202 Target: 5'-ATCCTGAGTGCCCTACTTGTTTTGCTC-3'      (SEQ ID NO: 1700)

5'-AACAGCCAGUUCUCCCAAAUUCUCAGA-3'   (SEQ ID NO: 4005)
                      3'-UUGUCGGUCAAGAGGGUUUAAGAGUCU-5'   (SEQ ID NO: 1125)
CKAP5-5246 Target: 5'-AACAGCCAGTTCTCCCAAATTCTCAGA-3'      (SEQ ID NO: 1701)

5'-GAGCUUGUUAUGAAGUGUCUCUGGAGA-3'   (SEQ ID NO: 4006)
                      3'-CUCGAACAAUACUUCACAGAGACCUCU-5'   (SEQ ID NO: 1126)
CKAP5-5271 Target: 5'-GAGCTTGTTATGAAGTGTCTCTGGAGA-3'      (SEQ ID NO: 1702)

5'-UUCGACUGUUGCCUGAUACCAUCAAUA-3'   (SEQ ID NO: 4007)
                      3'-AAGCUGACAACGGACUAUGGUAGUUAU-5'   (SEQ ID NO: 1127)
CKAP5-5302 Target: 5'-TTCGACTGTTGCCTGATACCATCAATA-3'      (SEQ ID NO: 1703)

5'-CUGUUGCCUGAUACCAUCAAUAGCAUU-3'   (SEQ ID NO: 4008)
                      3'-GACAACGGACUAUGGUAGUUAUCGUAA-5'   (SEQ ID NO: 1128)
CKAP5-5307 Target: 5'-CTGTTGCCTGATACCATCAATAGCATT-3'      (SEQ ID NO: 1704)

5'-GCCUGAUACCAUCAAUAGCAUUAACCU-3'   (SEQ ID NO: 4009)
                      3'-CGGACUAUGGUAGUUAUCGUAAUUGGA-5'   (SEQ ID NO: 1129)
CKAP5-5312 Target: 5'-GCCTGATACCATCAATAGCATTAACCT-3'      (SEQ ID NO: 1705)

5'-CCAUCAAUAGCAUUAACCUAGACAGAA-3'   (SEQ ID NO: 4010)
                      3'-GGUAGUUAUCGUAAUUGGAUCUGUCUU-5'   (SEQ ID NO: 1130)
CKAP5-5320 Target: 5'-CCATCAATAGCATTAACCTAGACAGAA-3'      (SEQ ID NO: 1706)

5'-AAUAGCAUUAACCUAGACAGAAUUCUU-3'   (SEQ ID NO: 4011)
                      3'-UUAUCGUAAUUGGAUCUGUCUUAAGAA-5'   (SEQ ID NO: 1131)
CKAP5-5325 Target: 5'-AATAGCATTAACCTAGACAGAATTCTT-3'      (SEQ ID NO: 1707)

5'-CAGAAUUCUUCUGGAUAUCCACAUUUU-3'   (SEQ ID NO: 4012)
                      3'-GUCUUAAGAAGACCUAUAGGUGUAAAA-5'   (SEQ ID NO: 1132)
CKAP5-5342 Target: 5'-CAGAATTCTTCTGGATATCCACATTTT-3'      (SEQ ID NO: 1708)

5'-UUCUGGAUAUCCACAUUUUCAUGAAGG-3'   (SEQ ID NO: 4013)
                      3'-AAGACCUAUAGGUGUAAAAGUACUUCC-5'   (SEQ ID NO: 1133)
CKAP5-5350 Target: 5'-TTCTGGATATCCACATTTTCATGAAGG-3'      (SEQ ID NO: 1709)

5'-CCAAAGAGAAACUGAAGCAAUGCAAAA-3'   (SEQ ID NO: 4014)
                      3'-GGUUUCUCUUUGACUUCGUUACGUUUU-5'   (SEQ ID NO: 1134)
CKAP5-5383 Target: 5'-CCAAAGAGAAACTGAAGCAATGCAAAA-3'      (SEQ ID NO: 1710)

5'-GAGAAACUGAAGCAAUGCAAAAGUGAA-3'   (SEQ ID NO: 4015)
                      3'-CUCUUUGACUUCGUUACGUUUUCACUU-5'   (SEQ ID NO: 1135)
CKAP5-5388 Target: 5'-GAGAAACTGAAGCAATGCAAAAGTGAA-3'      (SEQ ID NO: 1711)

5'-GCCGGAUGAUGAAGCACAGUAUGGACC-3'   (SEQ ID NO: 4016)
                      3'-CGGCCUACUACUUCGUGUCAUACCUGG-5'   (SEQ ID NO: 1136)
CKAP5-5536 Target: 5'-GCCGGATGATGAAGCACAGTATGGACC-3'      (SEQ ID NO: 1712)

5'-AACAGAAAAGGGAGCAUCUCGAAUAGA-3'   (SEQ ID NO: 4017)
                      3'-UUGUCUUUUCCCUCGUAGAGCUUAUCU-5'   (SEQ ID NO: 1137)
CKAP5-5588 Target: 5'-AACAGAAAAGGGAGCATCTCGAATAGA-3'      (SEQ ID NO: 1713)

5'-AAAGGGAGCAUCUCGAAUAGAUGAAAA-3'   (SEQ ID NO: 4018)
                      3'-UUUCCCUCGUAGAGCUUAUCUACUUUU-5'   (SEQ ID NO: 1138)
CKAP5-5594 Target: 5'-AAAGGGAGCATCTCGAATAGATGAAAA-3'      (SEQ ID NO: 1714)

5'-GAGCAUCUCGAAUAGAUGAAAAAUCAU-3'   (SEQ ID NO: 4019)
                      3'-CUCGUAGAGCUUAUCUACUUUUUAGUA-5'   (SEQ ID NO: 1139)
CKAP5-5599 Target: 5'-GAGCATCTCGAATAGATGAAAAATCAT-3'      (SEQ ID NO: 1715)

5'-AAGAGGGACUAGCAGAGUUAUAUGAAU-3'   (SEQ ID NO: 4020)
                      3'-UUCUCCCUGAUCGUCUCAAUAUACUUA-5'   (SEQ ID NO: 1140)
CKAP5-5692 Target: 5'-AAGAGGGACTAGCAGAGTTATATGAAT-3'      (SEQ ID NO: 1716)

5'-AUACUCAGAUGCUGACAUUGAACCAUU-3'   (SEQ ID NO: 4021)
                      3'-UAUGAGUCUACGACUGUAACUUGGUAA-5'   (SEQ ID NO: 1141)
CKAP5-5729 Target: 5'-ATACTCAGATGCTGACATTGAACCATT-3'      (SEQ ID NO: 1717)

5'-AGCAUUCAGACCUGGAUUCUAACCAGA-3'   (SEQ ID NO: 4022)
                      3'-UCGUAAGUCUGGACCUAAGAUUGGUCU-5'   (SEQ ID NO: 1142)
CKAP5-6130 Target: 5'-AGCATTCAGACCTGGATTCTAACCAGA-3'      (SEQ ID NO: 1718)
```

TABLE 6-continued

Selected Human Anti-CKAP5 "Blunt/Blunt" DsiRNAs

```
                5'-CAGACCUGGAUUCUAACCAGACUCACU-3'    (SEQ ID NO: 4023)
                3'-GUCUGGACCUAAGAUUGGUCUGAGUGA-5'    (SEQ ID NO: 1143)
CKAP5-6136 Target: 5'-CAGACCTGGATTCTAACCAGACTCACT-3' (SEQ ID NO: 1719)

5'-CUGGAUUCUAACCAGACUCACUCUUCA-3'    (SEQ ID NO: 4024)
                3'-GACCUAAGAUUGGUCUGAGUGAGAAGU-5'    (SEQ ID NO: 1144)
CKAP5-6141 Target: 5'-CTGGATTCTAACCAGACTCACTCTTCA-3' (SEQ ID NO: 1720)

5'-CAGCUAACAUAGACGACUUGAAAAAAA-3'    (SEQ ID NO: 4025)
                3'-GUCGAUUGUAUCUGCUGAACUUUUUUU-5'    (SEQ ID NO: 1145)
CKAP5-6193 Target: 5'-CAGCTAACATAGACGACTTGAAAAAAA-3' (SEQ ID NO: 1721)

5'-AACAUAGACGACUUGAAAAAAAGACUG-3'    (SEQ ID NO: 4026)
                3'-UUGUAUCUGCUGAACUUUUUUUCUGAC-5'    (SEQ ID NO: 1146)
CKAP5-6198 Target: 5'-AACATAGACGACTTGAAAAAAAGACTG-3' (SEQ ID NO: 1722)

5'-AACUAGAAGUCCUCAUAGUUUAAAAUG-3'    (SEQ ID NO: 4027)
                3'-UUGAUCUUCAGGAGUAUCAAAUUUUAC-5'    (SEQ ID NO: 1147)
CKAP5-6294 Target: 5'-AACTAGAAGTCCTCATAGTTTAAAATG-3' (SEQ ID NO: 1723)

5'-UGGAUGAGUUUAGUGUACAGACUUGUA-3'    (SEQ ID NO: 4028)
                3'-ACCUACUCAAAUCACAUGUCUGAACAU-5'    (SEQ ID NO: 1148)
CKAP5-6459 Target: 5'-TGGATGAGTTTAGTGTACAGACTTGTA-3' (SEQ ID NO: 1724)

5'-CCCAGAUCCUUUUCUUUUCUUUUUAAU-3'    (SEQ ID NO: 4029)
                3'-GGGUCUAGGAAAAGAAAAGAAAAAUUA-5'    (SEQ ID NO: 1149)
CKAP5-6517 Target: 5'-CCCAGATCCTTTTCTTTTCTTTTTAAT-3' (SEQ ID NO: 1725)

5'-AUUGCUCAUUUGUAAAAUUGUCCUAAU-3'    (SEQ ID NO: 4030)
                3'-UAACGAGUAAACAUUUUAACAGGAUUA-5'    (SEQ ID NO: 1150)
CKAP5-6542 Target: 5'-ATTGCTCATTTGTAAAATTGTCCTAAT-3' (SEQ ID NO: 1726)

5'-CUGAAGGGUCACUGUAUUCUGUAUGAA-3'    (SEQ ID NO: 4031)
                3'-GACUUCCCAGUGACAUAAGACAUACUU-5'    (SEQ ID NO: 1151)
CKAP5-6648 Target: 5'-CTGAAGGGTCACTGTATTCTGTATGAA-3' (SEQ ID NO: 1727)

5'-GGGUCACUGUAUUCUGUAUGAAUGCAU-3'    (SEQ ID NO: 4032)
                3'-CCCAGUGACAUAAGACAUACUUACGUA-5'    (SEQ ID NO: 1152)
CKAP5-6653 Target: 5'-GGGTCACTGTATTCTGTATGAATGCAT-3' (SEQ ID NO: 1728)
```

TABLE 7

DsiRNA Component 19 Nucleotide Target Sequences In CKAP5 mRNA

```
CKAP5-143 19 nt Target #1:   5'-GAAGCACAAUGGGAGAUGA-3'   (SEQ ID NO: 4033)

CKAP5-143 19 nt Target #2:   5'-GGAAGCACAAUGGGAGAUG-3'   (SEQ ID NO: 4609)

CKAP5-143 19 nt Target #3:   5'-UGGAAGCACAAUGGGAGAU-3'   (SEQ ID NO: 5185)

CKAP5-145 19 nt Target #1:   5'-AGCACAAUGGGAGAUGACA-3'   (SEQ ID NO: 4034)

CKAP5-145 19 nt Target #2:   5'-AAGCACAAUGGGAGAUGAC-3'   (SEQ ID NO: 4610)

CKAP5-145 19 nt Target #3:   5'-GAAGCACAAUGGGAGAUGA-3'   (SEQ ID NO: 5186)

CKAP5-147 19 nt Target #1:   5'-CACAAUGGGAGAUGACAGU-3'   (SEQ ID NO: 4035)

CKAP5-147 19 nt Target #2:   5'-GCACAAUGGGAGAUGACAG-3'   (SEQ ID NO: 4611)

CKAP5-147 19 nt Target #3:   5'-AGCACAAUGGGAGAUGACA-3'   (SEQ ID NO: 5187)

CKAP5-149 19 nt Target #1:   5'-CAAUGGGAGAUGACAGUGA-3'   (SEQ ID NO: 4036)

CKAP5-149 19 nt Target #2:   5'-ACAAUGGGAGAUGACAGUG-3'   (SEQ ID NO: 4612)

CKAP5-149 19 nt Target #3:   5'-CACAAUGGGAGAUGACAGU-3'   (SEQ ID NO: 5188)

CKAP5-151 19 nt Target #1:   5'-AUGGGAGAUGACAGUGAGU-3'   (SEQ ID NO: 4037)

CKAP5-151 19 nt Target #2:   5'-AAUGGGAGAUGACAGUGAG-3'   (SEQ ID NO: 4613)

CKAP5-151 19 nt Target #3:   5'-CAAUGGGAGAUGACAGUGA-3'   (SEQ ID NO: 5189)
```

TABLE 7-continued

DsiRNA Component 19 Nucleotide Target Sequences In CKAP5 mRNA

| | | |
|---|---|---|
| CKAP5-153 19 nt Target #1: | 5'-GGGAGAUGACAGUGAGUGG-3' | (SEQ ID NO: 4038) |
| CKAP5-153 19 nt Target #2: | 5'-UGGGAGAUGACAGUGAGUG-3' | (SEQ ID NO: 4614) |
| CKAP5-153 19 nt Target #3: | 5'-AUGGGAGAUGACAGUGAGU-3' | (SEQ ID NO: 5190) |
| CKAP5-155 19 nt Target #1: | 5'-GAGAUGACAGUGAGUGGUU-3' | (SEQ ID NO: 4039) |
| CKAP5-155 19 nt Target #2: | 5'-GGAGAUGACAGUGAGUGGU-3' | (SEQ ID NO: 4615) |
| CKAP5-155 19 nt Target #3: | 5'-GGGAGAUGACAGUGAGUGG-3' | (SEQ ID NO: 5191) |
| CKAP5-157 19 nt Target #1: | 5'-GAUGACAGUGAGUGGUUGA-3' | (SEQ ID NO: 4040) |
| CKAP5-157 19 nt Target #2: | 5'-AGAUGACAGUGAGUGGUUG-3' | (SEQ ID NO: 4616) |
| CKAP5-157 19 nt Target #3: | 5'-GAGAUGACAGUGAGUGGUU-3' | (SEQ ID NO: 5192) |
| CKAP5-159 19 nt Target #1: | 5'-UGACAGUGAGUGGUUGAAA-3' | (SEQ ID NO: 4041) |
| CKAP5-159 19 nt Target #2: | 5'-AUGACAGUGAGUGGUUGAA-3' | (SEQ ID NO: 4617) |
| CKAP5-159 19 nt Target #3: | 5'-GAUGACAGUGAGUGGUUGA-3' | (SEQ ID NO: 5193) |
| CKAP5-246 19 nt Target #1: | 5'-GAAGAUCUUCCAGAAAAUA-3' | (SEQ ID NO: 4042) |
| CKAP5-246 19 nt Target #2: | 5'-UGAAGAUCUUCCAGAAAAU-3' | (SEQ ID NO: 4618) |
| CKAP5-246 19 nt Target #3: | 5'-CUGAAGAUCUUCCAGAAAA-3' | (SEQ ID NO: 5194) |
| CKAP5-248 19 nt Target #1: | 5'-AGAUCUUCCAGAAAAUAAA-3' | (SEQ ID NO: 4043) |
| CKAP5-248 19 nt Target #2: | 5'-AAGAUCUUCCAGAAAAUAA-3' | (SEQ ID NO: 4619) |
| CKAP5-248 19 nt Target #3: | 5'-GAAGAUCUUCCAGAAAAUA-3' | (SEQ ID NO: 5195) |
| CKAP5-250 19 nt Target #1: | 5'-AUCUUCCAGAAAAUAAAGG-3' | (SEQ ID NO: 4044) |
| CKAP5-250 19 nt Target #2: | 5'-GAUCUUCCAGAAAAUAAAG-3' | (SEQ ID NO: 4620) |
| CKAP5-250 19 nt Target #3: | 5'-AGAUCUUCCAGAAAAUAAA-3' | (SEQ ID NO: 5196) |
| CKAP5-252 19 nt Target #1: | 5'-CUUCCAGAAAAUAAAGGAU-3' | (SEQ ID NO: 4045) |
| CKAP5-252 19 nt Target #2: | 5'-UCUUCCAGAAAAUAAAGGA-3' | (SEQ ID NO: 4621) |
| CKAP5-252 19 nt Target #3: | 5'-AUCUUCCAGAAAAUAAAGG-3' | (SEQ ID NO: 5197) |
| CKAP5-254 19 nt Target #1: | 5'-UCCAGAAAAUAAAGGAUGA-3' | (SEQ ID NO: 4046) |
| CKAP5-254 19 nt Target #2: | 5'-UUCCAGAAAAUAAAGGAUG-3' | (SEQ ID NO: 4622) |
| CKAP5-254 19 nt Target #3: | 5'-CUUCCAGAAAAUAAAGGAU-3' | (SEQ ID NO: 5198) |
| CKAP5-256 19 nt Target #1: | 5'-CAGAAAAUAAAGGAUGAAA-3' | (SEQ ID NO: 4047) |
| CKAP5-256 19 nt Target #2: | 5'-CCAGAAAAUAAAGGAUGAA-3' | (SEQ ID NO: 4623) |
| CKAP5-256 19 nt Target #3: | 5'-UCCAGAAAAUAAAGGAUGA-3' | (SEQ ID NO: 5199) |
| CKAP5-258 19 nt Target #1: | 5'-GAAAAUAAAGGAUGAAAAG-3' | (SEQ ID NO: 4048) |
| CKAP5-258 19 nt Target #2: | 5'-AGAAAAUAAAGGAUGAAAA-3' | (SEQ ID NO: 4624) |
| CKAP5-258 19 nt Target #3: | 5'-CAGAAAAUAAAGGAUGAAA-3' | (SEQ ID NO: 5200) |
| CKAP5-260 19 nt Target #1: | 5'-AAAUAAAGGAUGAAAAGAG-3' | (SEQ ID NO: 4049) |
| CKAP5-260 19 nt Target #2: | 5'-AAAAUAAAGGAUGAAAAGA-3' | (SEQ ID NO: 4625) |
| CKAP5-260 19 nt Target #3: | 5'-GAAAAUAAAGGAUGAAAAG-3' | (SEQ ID NO: 5201) |
| CKAP5-308 19 nt Target #1: | 5'-UCAAAAAAUUUGUCACUGA-3' | (SEQ ID NO: 4050) |
| CKAP5-308 19 nt Target #2: | 5'-AUCAAAAAAUUUGUCACUG-3' | (SEQ ID NO: 4626) |
| CKAP5-308 19 nt Target #3: | 5'-GAUCAAAAAAUUUGUCACU-3' | (SEQ ID NO: 5202) |

TABLE 7-continued

DsiRNA Component 19 Nucleotide Target Sequences In CKAP5 mRNA

| | | |
|---|---|---|
| CKAP5-310 19 nt Target #1: | 5'-AAAAAAUUUGUCACUGAUU-3' | (SEQ ID NO: 4051) |
| CKAP5-310 19 nt Target #2: | 5'-CAAAAAAUUUGUCACUGAU-3' | (SEQ ID NO: 4627) |
| CKAP5-310 19 nt Target #3: | 5'-UCAAAAAAUUUGUCACUGA-3' | (SEQ ID NO: 5203) |
| CKAP5-312 19 nt Target #1: | 5'-AAAAUUUGUCACUGAUUCC-3' | (SEQ ID NO: 4052) |
| CKAP5-312 19 nt Target #2: | 5'-AAAAAUUUGUCACUGAUUC-3' | (SEQ ID NO: 4628) |
| CKAP5-312 19 nt Target #3: | 5'-AAAAAAUUUGUCACUGAUU-3' | (SEQ ID NO: 5204) |
| CKAP5-314 19 nt Target #1: | 5'-AAUUUGUCACUGAUUCCAA-3' | (SEQ ID NO: 4053) |
| CKAP5-314 19 nt Target #2: | 5'-AAAUUUGUCACUGAUUCCA-3' | (SEQ ID NO: 4629) |
| CKAP5-314 19 nt Target #3: | 5'-AAAAUUUGUCACUGAUUCC-3' | (SEQ ID NO: 5205) |
| CKAP5-316 19 nt Target #1: | 5'-UUUGUCACUGAUUCCAAUG-3' | (SEQ ID NO: 4054) |
| CKAP5-316 19 nt Target #2: | 5'-AUUUGUCACUGAUUCCAAU-3' | (SEQ ID NO: 4630) |
| CKAP5-316 19 nt Target #3: | 5'-AAUUUGUCACUGAUUCCAA-3' | (SEQ ID NO: 5206) |
| CKAP5-318 19 nt Target #1: | 5'-UGUCACUGAUUCCAAUGCA-3' | (SEQ ID NO: 4055) |
| CKAP5-318 19 nt Target #2: | 5'-UUGUCACUGAUUCCAAUGC-3' | (SEQ ID NO: 4631) |
| CKAP5-318 19 nt Target #3: | 5'-UUUGUCACUGAUUCCAAUG-3' | (SEQ ID NO: 5207) |
| CKAP5-320 19 nt Target #1: | 5'-UCACUGAUUCCAAUGCAGU-3' | (SEQ ID NO: 4056) |
| CKAP5-320 19 nt Target #2: | 5'-GUCACUGAUUCCAAUGCAG-3' | (SEQ ID NO: 4632) |
| CKAP5-320 19 nt Target #3: | 5'-UGUCACUGAUUCCAAUGCA-3' | (SEQ ID NO: 5208) |
| CKAP5-322 19 nt Target #1: | 5'-ACUGAUUCCAAUGCAGUGG-3' | (SEQ ID NO: 4057) |
| CKAP5-322 19 nt Target #2: | 5'-CACUGAUUCCAAUGCAGUG-3' | (SEQ ID NO: 4633) |
| CKAP5-322 19 nt Target #3: | 5'-UCACUGAUUCCAAUGCAGU-3' | (SEQ ID NO: 5209) |
| CKAP5-324 19 nt Target #1: | 5'-UGAUUCCAAUGCAGUGGUU-3' | (SEQ ID NO: 4058) |
| CKAP5-324 19 nt Target #2: | 5'-CUGAUUCCAAUGCAGUGGU-3' | (SEQ ID NO: 4634) |
| CKAP5-324 19 nt Target #3: | 5'-ACUGAUUCCAAUGCAGUGG-3' | (SEQ ID NO: 5210) |
| CKAP5-326 19 nt Target #1: | 5'-AUUCCAAUGCAGUGGUUCA-3' | (SEQ ID NO: 4059) |
| CKAP5-326 19 nt Target #2: | 5'-GAUUCCAAUGCAGUGGUUC-3' | (SEQ ID NO: 4635) |
| CKAP5-326 19 nt Target #3: | 5'-UGAUUCCAAUGCAGUGGUU-3' | (SEQ ID NO: 5211) |
| CKAP5-328 19 nt Target #1: | 5'-UCCAAUGCAGUGGUUCAAU-3' | (SEQ ID NO: 4060) |
| CKAP5-328 19 nt Target #2: | 5'-UUCCAAUGCAGUGGUUCAA-3' | (SEQ ID NO: 4636) |
| CKAP5-328 19 nt Target #3: | 5'-AUUCCAAUGCAGUGGUUCA-3' | (SEQ ID NO: 5212) |
| CKAP5-330 19 nt Target #1: | 5'-CAAUGCAGUGGUUCAAUUG-3' | (SEQ ID NO: 4061) |
| CKAP5-330 19 nt Target #2: | 5'-CCAAUGCAGUGGUUCAAUU-3' | (SEQ ID NO: 4637) |
| CKAP5-330 19 nt Target #3: | 5'-UCCAAUGCAGUGGUUCAAU-3' | (SEQ ID NO: 5213) |
| CKAP5-332 19 nt Target #1: | 5'-AUGCAGUGGUUCAAUUGAA-3' | (SEQ ID NO: 4062) |
| CKAP5-332 19 nt Target #2: | 5'-AAUGCAGUGGUUCAAUUGA-3' | (SEQ ID NO: 4638) |
| CKAP5-332 19 nt Target #3: | 5'-CAAUGCAGUGGUUCAAUUG-3' | (SEQ ID NO: 5214) |
| CKAP5-334 19 nt Target #1: | 5'-GCAGUGGUUCAAUUGAAAG-3' | (SEQ ID NO: 4063) |
| CKAP5-334 19 nt Target #2: | 5'-UGCAGUGGUUCAAUUGAAA-3' | (SEQ ID NO: 4639) |
| CKAP5-334 19 nt Target #3: | 5'-AUGCAGUGGUUCAAUUGAA-3' | (SEQ ID NO: 5215) |

TABLE 7-continued

DsiRNA Component 19 Nucleotide Target Sequences In CKAP5 mRNA

| | | |
|---|---|---|
| CKAP5-336 19 nt Target #1: | 5'-AGUGGUUCAAUUGAAAGGA-3' | (SEQ ID NO: 4064) |
| CKAP5-336 19 nt Target #2: | 5'-CAGUGGUUCAAUUGAAAGG-3' | (SEQ ID NO: 4640) |
| CKAP5-336 19 nt Target #3: | 5'-GCAGUGGUUCAAUUGAAAG-3' | (SEQ ID NO: 5216) |
| CKAP5-565 19 nt Target #1: | 5'-AAGAUCAUAGUGGCCUGUA-3' | (SEQ ID NO: 4065) |
| CKAP5-565 19 nt Target #2: | 5'-CAAGAUCAUAGUGGCCUGU-3' | (SEQ ID NO: 4641) |
| CKAP5-565 19 nt Target #3: | 5'-CCAAGAUCAUAGUGGCCUG-3' | (SEQ ID NO: 5217) |
| CKAP5-567 19 nt Target #1: | 5'-GAUCAUAGUGGCCUGUAUA-3' | (SEQ ID NO: 4066) |
| CKAP5-567 19 nt Target #2: | 5'-AGAUCAUAGUGGCCUGUAU-3' | (SEQ ID NO: 4642) |
| CKAP5-567 19 nt Target #3: | 5'-AAGAUCAUAGUGGCCUGUA-3' | (SEQ ID NO: 5218) |
| CKAP5-569 19 nt Target #1: | 5'-UCAUAGUGGCCUGUAUAGA-3' | (SEQ ID NO: 4067) |
| CKAP5-569 19 nt Target #2: | 5'-AUCAUAGUGGCCUGUAUAG-3' | (SEQ ID NO: 4643) |
| CKAP5-569 19 nt Target #3: | 5'-GAUCAUAGUGGCCUGUAUA-3' | (SEQ ID NO: 5219) |
| CKAP5-590 19 nt Target #1: | 5'-CACUGAGGAAAGCCUUAAG-3' | (SEQ ID NO: 4068) |
| CKAP5-590 19 nt Target #2: | 5'-ACACUGAGGAAAGCCUUAA-3' | (SEQ ID NO: 4644) |
| CKAP5-590 19 nt Target #3: | 5'-GACACUGAGGAAAGCCUUA-3' | (SEQ ID NO: 5220) |
| CKAP5-592 19 nt Target #1: | 5'-CUGAGGAAAGCCUUAAGUG-3' | (SEQ ID NO: 4069) |
| CKAP5-592 19 nt Target #2: | 5'-ACUGAGGAAAGCCUUAAGU-3' | (SEQ ID NO: 4645) |
| CKAP5-592 19 nt Target #3: | 5'-CACUGAGGAAAGCCUUAAG-3' | (SEQ ID NO: 5221) |
| CKAP5-594 19 nt Target #1: | 5'-GAGGAAAGCCUUAAGUGAA-3' | (SEQ ID NO: 4070) |
| CKAP5-594 19 nt Target #2: | 5'-UGAGGAAAGCCUUAAGUGA-3' | (SEQ ID NO: 4646) |
| CKAP5-594 19 nt Target #3: | 5'-CUGAGGAAAGCCUUAAGUG-3' | (SEQ ID NO: 5222) |
| CKAP5-596 19 nt Target #1: | 5'-GGAAAGCCUUAAGUGAAUU-3' | (SEQ ID NO: 4071) |
| CKAP5-596 19 nt Target #2: | 5'-AGGAAAGCCUUAAGUGAAU-3' | (SEQ ID NO: 4647) |
| CKAP5-596 19 nt Target #3: | 5'-GAGGAAAGCCUUAAGUGAA-3' | (SEQ ID NO: 5223) |
| CKAP5-598 19 nt Target #1: | 5'-AAAGCCUUAAGUGAAUUUG-3' | (SEQ ID NO: 4072) |
| CKAP5-598 19 nt Target #2: | 5'-GAAAGCCUUAAGUGAAUUU-3' | (SEQ ID NO: 4648) |
| CKAP5-598 19 nt Target #3: | 5'-GGAAAGCCUUAAGUGAAUU-3' | (SEQ ID NO: 5224) |
| CKAP5-600 19 nt Target #1: | 5'-AGCCUUAAGUGAAUUUGGU-3' | (SEQ ID NO: 4073) |
| CKAP5-600 19 nt Target #2: | 5'-AAGCCUUAAGUGAAUUUGG-3' | (SEQ ID NO: 4649) |
| CKAP5-600 19 nt Target #3: | 5'-AAAGCCUUAAGUGAAUUUG-3' | (SEQ ID NO: 5225) |
| CKAP5-602 19 nt Target #1: | 5'-CCUUAAGUGAAUUUGGUUC-3' | (SEQ ID NO: 4074) |
| CKAP5-602 19 nt Target #2: | 5'-GCCUUAAGUGAAUUUGGUU-3' | (SEQ ID NO: 4650) |
| CKAP5-602 19 nt Target #3: | 5'-AGCCUUAAGUGAAUUUGGU-3' | (SEQ ID NO: 5226) |
| CKAP5-604 19 nt Target #1: | 5'-UUAAGUGAAUUUGGUUCCA-3' | (SEQ ID NO: 4075) |
| CKAP5-604 19 nt Target #2: | 5'-CUUAAGUGAAUUUGGUUCC-3' | (SEQ ID NO: 4651) |
| CKAP5-604 19 nt Target #3: | 5'-CCUUAAGUGAAUUUGGUUC-3' | (SEQ ID NO: 5227) |
| CKAP5-606 19 nt Target #1: | 5'-AAGUGAAUUUGGUUCCAAA-3' | (SEQ ID NO: 4076) |
| CKAP5-606 19 nt Target #2: | 5'-UAAGUGAAUUUGGUUCCAA-3' | (SEQ ID NO: 4652) |
| CKAP5-606 19 nt Target #3: | 5'-UUAAGUGAAUUUGGUUCCA-3' | (SEQ ID NO: 5228) |

TABLE 7-continued

DsiRNA Component 19 Nucleotide Target Sequences In CKAP5 mRNA

| | | |
|---|---|---|
| CKAP5-608 19 nt Target #1: | 5'-GUGAAUUUGGUUCCAAAAU-3' | (SEQ ID NO: 4077) |
| CKAP5-608 19 nt Target #2: | 5'-AGUGAAUUUGGUUCCAAAA-3' | (SEQ ID NO: 4653) |
| CKAP5-608 19 nt Target #3: | 5'-AAGUGAAUUUGGUUCCAAA-3' | (SEQ ID NO: 5229) |
| CKAP5-610 19 nt Target #1: | 5'-GAAUUUGGUUCCAAAAUCA-3' | (SEQ ID NO: 4078) |
| CKAP5-610 19 nt Target #2: | 5'-UGAAUUUGGUUCCAAAAUC-3' | (SEQ ID NO: 4654) |
| CKAP5-610 19 nt Target #3: | 5'-GUGAAUUUGGUUCCAAAAU-3' | (SEQ ID NO: 5230) |
| CKAP5-612 19 nt Target #1: | 5'-AUUUGGUUCCAAAAUCAUC-3' | (SEQ ID NO: 4079) |
| CKAP5-612 19 nt Target #2: | 5'-AAUUUGGUUCCAAAAUCAU-3' | (SEQ ID NO: 4655) |
| CKAP5-612 19 nt Target #3: | 5'-GAAUUUGGUUCCAAAAUCA-3' | (SEQ ID NO: 5231) |
| CKAP5-847 19 nt Target #1: | 5'-CGUUCCCAACAAGAACUAG-3' | (SEQ ID NO: 4080) |
| CKAP5-847 19 nt Target #2: | 5'-UCGUUCCCAACAAGAACUA-3' | (SEQ ID NO: 4656) |
| CKAP5-847 19 nt Target #3: | 5'-UUCGUUCCCAACAAGAACU-3' | (SEQ ID NO: 5232) |
| CKAP5-849 19 nt Target #1: | 5'-UUCCCAACAAGAACUAGAA-3' | (SEQ ID NO: 4081) |
| CKAP5-849 19 nt Target #2: | 5'-GUUCCCAACAAGAACUAGA-3' | (SEQ ID NO: 4657) |
| CKAP5-849 19 nt Target #3: | 5'-CGUUCCCAACAAGAACUAG-3' | (SEQ ID NO: 5233) |
| CKAP5-851 19 nt Target #1: | 5'-CCCAACAAGAACUAGAAGC-3' | (SEQ ID NO: 4082) |
| CKAP5-851 19 nt Target #2: | 5'-UCCCAACAAGAACUAGAAG-3' | (SEQ ID NO: 4658) |
| CKAP5-851 19 nt Target #3: | 5'-UUCCCAACAAGAACUAGAA-3' | (SEQ ID NO: 5234) |
| CKAP5-853 19 nt Target #1: | 5'-CAACAAGAACUAGAAGCUA-3' | (SEQ ID NO: 4083) |
| CKAP5-853 19 nt Target #2: | 5'-CCAACAAGAACUAGAAGCU-3' | (SEQ ID NO: 4659) |
| CKAP5-853 19 nt Target #3: | 5'-CCCAACAAGAACUAGAAGC-3' | (SEQ ID NO: 5235) |
| CKAP5-855 19 nt Target #1: | 5'-ACAAGAACUAGAAGCUAAA-3' | (SEQ ID NO: 4084) |
| CKAP5-855 19 nt Target #2: | 5'-AACAAGAACUAGAAGCUAA-3' | (SEQ ID NO: 4660) |
| CKAP5-855 19 nt Target #3: | 5'-CAACAAGAACUAGAAGCUA-3' | (SEQ ID NO: 5236) |
| CKAP5-884 19 nt Target #1: | 5'-AACAGUCUGCUGGUGGAGA-3' | (SEQ ID NO: 4085) |
| CKAP5-884 19 nt Target #2: | 5'-CAACAGUCUGCUGGUGGAG-3' | (SEQ ID NO: 4661) |
| CKAP5-884 19 nt Target #3: | 5'-ACAACAGUCUGCUGGUGGA-3' | (SEQ ID NO: 5237) |
| CKAP5-886 19 nt Target #1: | 5'-CAGUCUGCUGGUGGAGAUG-3' | (SEQ ID NO: 4086) |
| CKAP5-886 19 nt Target #2: | 5'-ACAGUCUGCUGGUGGAGAU-3' | (SEQ ID NO: 4662) |
| CKAP5-886 19 nt Target #3: | 5'-AACAGUCUGCUGGUGGAGA-3' | (SEQ ID NO: 5238) |
| CKAP5-914 19 nt Target #1: | 5'-GUGGUGAUGAUGGUGAUGA-3' | (SEQ ID NO: 4087) |
| CKAP5-914 19 nt Target #2: | 5'-GGUGGUGAUGAUGGUGAUG-3' | (SEQ ID NO: 4663) |
| CKAP5-914 19 nt Target #3: | 5'-AGGUGGUGAUGAUGGUGAU-3' | (SEQ ID NO: 5239) |
| CKAP5-916 19 nt Target #1: | 5'-GGUGAUGAUGGUGAUGAGG-3' | (SEQ ID NO: 4088) |
| CKAP5-916 19 nt Target #2: | 5'-UGGUGAUGAUGGUGAUGAG-3' | (SEQ ID NO: 4664) |
| CKAP5-916 19 nt Target #3: | 5'-GUGGUGAUGAUGGUGAUGA-3' | (SEQ ID NO: 5240) |
| CKAP5-976 19 nt Target #1: | 5'-AUCCUUUCCAAACUUCCCA-3' | (SEQ ID NO: 4089) |
| CKAP5-976 19 nt Target #2: | 5'-AAUCCUUUCCAAACUUCCC-3' | (SEQ ID NO: 4665) |
| CKAP5-976 19 nt Target #3: | 5'-AAAUCCUUUCCAAACUUCC-3' | (SEQ ID NO: 5241) |

TABLE 7-continued

DsiRNA Component 19 Nucleotide Target Sequences In CKAP5 mRNA

| | | |
|---|---|---|
| CKAP5-978 19 nt Target #1: | 5'-CCUUUCCAAACUUCCCAAA-3' | (SEQ ID NO: 4090) |
| CKAP5-978 19 nt Target #2: | 5'-UCCUUUCCAAACUUCCCAA-3' | (SEQ ID NO: 4666) |
| CKAP5-978 19 nt Target #3: | 5'-AUCCUUUCCAAACUUCCCA-3' | (SEQ ID NO: 5242) |
| CKAP5-980 19 nt Target #1: | 5'-UUUCCAAACUUCCCAAAGA-3' | (SEQ ID NO: 4091) |
| CKAP5-980 19 nt Target #2: | 5'-CUUUCCAAACUUCCCAAAG-3' | (SEQ ID NO: 4667) |
| CKAP5-980 19 nt Target #3: | 5'-CCUUUCCAAACUUCCCAAA-3' | (SEQ ID NO: 5243) |
| CKAP5-982 19 nt Target #1: | 5'-UCCAAACUUCCCAAAGACU-3' | (SEQ ID NO: 4092) |
| CKAP5-982 19 nt Target #2: | 5'-UUCCAAACUUCCCAAAGAC-3' | (SEQ ID NO: 4668) |
| CKAP5-982 19 nt Target #3: | 5'-UUUCCAAACUUCCCAAAGA-3' | (SEQ ID NO: 5244) |
| CKAP5-984 19 nt Target #1: | 5'-CAAACUUCCCAAAGACUUU-3' | (SEQ ID NO: 4093) |
| CKAP5-984 19 nt Target #2: | 5'-CCAAACUUCCCAAAGACUU-3' | (SEQ ID NO: 4669) |
| CKAP5-984 19 nt Target #3: | 5'-UCCAAACUUCCCAAAGACU-3' | (SEQ ID NO: 5245) |
| CKAP5-986 19 nt Target #1: | 5'-AACUUCCCAAAGACUUUUA-3' | (SEQ ID NO: 4094) |
| CKAP5-986 19 nt Target #2: | 5'-AAACUUCCCAAAGACUUUU-3' | (SEQ ID NO: 4670) |
| CKAP5-986 19 nt Target #3: | 5'-CAAACUUCCCAAAGACUUU-3' | (SEQ ID NO: 5246) |
| CKAP5-988 19 nt Target #1: | 5'-CUUCCCAAAGACUUUUAUG-3' | (SEQ ID NO: 4095) |
| CKAP5-988 19 nt Target #2: | 5'-ACUUCCCAAAGACUUUUAU-3' | (SEQ ID NO: 4671) |
| CKAP5-988 19 nt Target #3: | 5'-AACUUCCCAAAGACUUUUA-3' | (SEQ ID NO: 5247) |
| CKAP5-990 19 nt Target #1: | 5'-UCCCAAAGACUUUUAUGAC-3' | (SEQ ID NO: 4096) |
| CKAP5-990 19 nt Target #2: | 5'-UUCCCAAAGACUUUUAUGA-3' | (SEQ ID NO: 4672) |
| CKAP5-990 19 nt Target #3: | 5'-CUUCCCAAAGACUUUUAUG-3' | (SEQ ID NO: 5248) |
| CKAP5-992 19 nt Target #1: | 5'-CCAAAGACUUUUAUGACAA-3' | (SEQ ID NO: 4097) |
| CKAP5-992 19 nt Target #2: | 5'-CCCAAAGACUUUUAUGACA-3' | (SEQ ID NO: 4673) |
| CKAP5-992 19 nt Target #3: | 5'-UCCCAAAGACUUUUAUGAC-3' | (SEQ ID NO: 5249) |
| CKAP5-994 19 nt Target #1: | 5'-AAAGACUUUUAUGACAAAA-3' | (SEQ ID NO: 4098) |
| CKAP5-994 19 nt Target #2: | 5'-CAAAGACUUUUAUGACAAA-3' | (SEQ ID NO: 4674) |
| CKAP5-994 19 nt Target #3: | 5'-CCAAAGACUUUUAUGACAA-3' | (SEQ ID NO: 5250) |
| CKAP5-996 19 nt Target #1: | 5'-AGACUUUUAUGACAAAAUU-3' | (SEQ ID NO: 4099) |
| CKAP5-996 19 nt Target #2: | 5'-AAGACUUUUAUGACAAAAU-3' | (SEQ ID NO: 4675) |
| CKAP5-996 19 nt Target #3: | 5'-AAAGACUUUUAUGACAAAA-3' | (SEQ ID NO: 5251) |
| CKAP5-998 19 nt Target #1: | 5'-ACUUUUAUGACAAAAUUGA-3' | (SEQ ID NO: 4100) |
| CKAP5-998 19 nt Target #2: | 5'-GACUUUUAUGACAAAAUUG-3' | (SEQ ID NO: 4676) |
| CKAP5-998 19 nt Target #3: | 5'-AGACUUUUAUGACAAAAUU-3' | (SEQ ID NO: 5252) |
| CKAP5-1000 19 nt Target #1: | 5'-UUUUAUGACAAAAUUGAGG-3' | (SEQ ID NO: 4101) |
| CKAP5-1000 19 nt Target #2: | 5'-CUUUUAUGACAAAAUUGAG-3' | (SEQ ID NO: 4677) |
| CKAP5-1000 19 nt Target #3: | 5'-ACUUUUAUGACAAAAUUGA-3' | (SEQ ID NO: 5253) |
| CKAP5-1002 19 nt Target #1: | 5'-UUAUGACAAAAUUGAGGCA-3' | (SEQ ID NO: 4102) |
| CKAP5-1002 19 nt Target #2: | 5'-UUUAUGACAAAAUUGAGGC-3' | (SEQ ID NO: 4678) |
| CKAP5-1002 19 nt Target #3: | 5'-UUUUAUGACAAAAUUGAGG-3' | (SEQ ID NO: 5254) |

TABLE 7-continued

DsiRNA Component 19 Nucleotide Target Sequences In CKAP5 mRNA

| | | |
|---|---|---|
| CKAP5-1004 19 nt Target #1: | 5'-AUGACAAAAUUGAGGCAAA-3' | (SEQ ID NO: 4103) |
| CKAP5-1004 19 nt Target #2: | 5'-UAUGACAAAAUUGAGGCAA-3' | (SEQ ID NO: 4679) |
| CKAP5-1004 19 nt Target #3: | 5'-UUAUGACAAAAUUGAGGCA-3' | (SEQ ID NO: 5255) |
| CKAP5-1025 19 nt Target #1: | 5'-AAUGGCAAGAGAGAAAAGA-3' | (SEQ ID NO: 4104) |
| CKAP5-1025 19 nt Target #2: | 5'-AAAUGGCAAGAGAGAAAAG-3' | (SEQ ID NO: 4680) |
| CKAP5-1025 19 nt Target #3: | 5'-AAAAUGGCAAGAGAGAAAA-3' | (SEQ ID NO: 5256) |
| CKAP5-1127 19 nt Target #1: | 5'-AGGUUGUUGGAAAGGACAC-3' | (SEQ ID NO: 4105) |
| CKAP5-1127 19 nt Target #2: | 5'-AAGGUUGUUGGAAAGGACA-3' | (SEQ ID NO: 4681) |
| CKAP5-1127 19 nt Target #3: | 5'-GAAGGUUGUUGGAAAGGAC-3' | (SEQ ID NO: 5257) |
| CKAP5-1129 19 nt Target #1: | 5'-GUUGUUGGAAAGGACACCA-3' | (SEQ ID NO: 4106) |
| CKAP5-1129 19 nt Target #2: | 5'-GGUUGUUGGAAAGGACACC-3' | (SEQ ID NO: 4682) |
| CKAP5-1129 19 nt Target #3: | 5'-AGGUUGUUGGAAAGGACAC-3' | (SEQ ID NO: 5258) |
| CKAP5-1131 19 nt Target #1: | 5'-UGUUGGAAAGGACACCAAU-3' | (SEQ ID NO: 4107) |
| CKAP5-1131 19 nt Target #2: | 5'-UUGUUGGAAAGGACACCAA-3' | (SEQ ID NO: 4683) |
| CKAP5-1131 19 nt Target #3: | 5'-GUUGUUGGAAAGGACACCA-3' | (SEQ ID NO: 5259) |
| CKAP5-1133 19 nt Target #1: | 5'-UUGGAAAGGACACCAAUGU-3' | (SEQ ID NO: 4108) |
| CKAP5-1133 19 nt Target #2: | 5'-GUUGGAAAGGACACCAAUG-3' | (SEQ ID NO: 4684) |
| CKAP5-1133 19 nt Target #3: | 5'-UGUUGGAAAGGACACCAAU-3' | (SEQ ID NO: 5260) |
| CKAP5-1135 19 nt Target #1: | 5'-GGAAAGGACACCAAUGUCA-3' | (SEQ ID NO: 4109) |
| CKAP5-1135 19 nt Target #2: | 5'-UGGAAAGGACACCAAUGUC-3' | (SEQ ID NO: 4685) |
| CKAP5-1135 19 nt Target #3: | 5'-UUGGAAAGGACACCAAUGU-3' | (SEQ ID NO: 5261) |
| CKAP5-1137 19 nt Target #1: | 5'-AAAGGACACCAAUGUCAUG-3' | (SEQ ID NO: 4110) |
| CKAP5-1137 19 nt Target #2: | 5'-GAAAGGACACCAAUGUCAU-3' | (SEQ ID NO: 4686) |
| CKAP5-1137 19 nt Target #3: | 5'-GGAAAGGACACCAAUGUCA-3' | (SEQ ID NO: 5262) |
| CKAP5-1139 19 nt Target #1: | 5'-AGGACACCAAUGUCAUGUU-3' | (SEQ ID NO: 4111) |
| CKAP5-1139 19 nt Target #2: | 5'-AAGGACACCAAUGUCAUGU-3' | (SEQ ID NO: 4687) |
| CKAP5-1139 19 nt Target #3: | 5'-AAAGGACACCAAUGUCAUG-3' | (SEQ ID NO: 5263) |
| CKAP5-1141 19 nt Target #1: | 5'-GACACCAAUGUCAUGUUGG-3' | (SEQ ID NO: 4112) |
| CKAP5-1141 19 nt Target #2: | 5'-GGACACCAAUGUCAUGUUG-3' | (SEQ ID NO: 4688) |
| CKAP5-1141 19 nt Target #3: | 5'-AGGACACCAAUGUCAUGUU-3' | (SEQ ID NO: 5264) |
| CKAP5-1162 19 nt Target #1: | 5'-GCUUUGGCAGCAAAAUGUC-3' | (SEQ ID NO: 4113) |
| CKAP5-1162 19 nt Target #2: | 5'-GGCUUUGGCAGCAAAAUGU-3' | (SEQ ID NO: 4689) |
| CKAP5-1162 19 nt Target #3: | 5'-UGGCUUUGGCAGCAAAAUG-3' | (SEQ ID NO: 5265) |
| CKAP5-1164 19 nt Target #1: | 5'-UUUGGCAGCAAAAUGUCUU-3' | (SEQ ID NO: 4114) |
| CKAP5-1164 19 nt Target #2: | 5'-CUUUGGCAGCAAAAUGUCU-3' | (SEQ ID NO: 4690) |
| CKAP5-1164 19 nt Target #3: | 5'-GCUUUGGCAGCAAAAUGUC-3' | (SEQ ID NO: 5266) |
| CKAP5-1166 19 nt Target #1: | 5'-UGGCAGCAAAAUGUCUUAC-3' | (SEQ ID NO: 4115) |
| CKAP5-1166 19 nt Target #2: | 5'-UUGGCAGCAAAAUGUCUUA-3' | (SEQ ID NO: 4691) |
| CKAP5-1166 19 nt Target #3: | 5'-UUUGGCAGCAAAAUGUCUU-3' | (SEQ ID NO: 5267) |

TABLE 7-continued

DsiRNA Component 19 Nucleotide Target Sequences In CKAP5 mRNA

```
CKAP5-1168 19 nt Target #1:  5'-GCAGCAAAAUGUCUUACUG-3'  (SEQ ID NO: 4116)

CKAP5-1168 19 nt Target #2:  5'-GGCAGCAAAAUGUCUUACU-3'  (SEQ ID NO: 4692)

CKAP5-1168 19 nt Target #3:  5'-UGGCAGCAAAAUGUCUUAC-3'  (SEQ ID NO: 5268)

CKAP5-1170 19 nt Target #1:  5'-AGCAAAAUGUCUUACUGGC-3'  (SEQ ID NO: 4117)

CKAP5-1170 19 nt Target #2:  5'-CAGCAAAAUGUCUUACUGG-3'  (SEQ ID NO: 4693)

CKAP5-1170 19 nt Target #3:  5'-GCAGCAAAAUGUCUUACUG-3'  (SEQ ID NO: 5269)

CKAP5-1208 19 nt Target #1:  5'-AGAAAUUUGGACAAUAUGC-3'  (SEQ ID NO: 4118)

CKAP5-1208 19 nt Target #2:  5'-AAGAAAUUUGGACAAUAUG-3'  (SEQ ID NO: 4694)

CKAP5-1208 19 nt Target #3:  5'-GAAGAAAUUUGGACAAUAU-3'  (SEQ ID NO: 5270)

CKAP5-1210 19 nt Target #1:  5'-AAAUUUGGACAAUAUGCAG-3'  (SEQ ID NO: 4119)

CKAP5-1210 19 nt Target #2:  5'-GAAAUUUGGACAAUAUGCA-3'  (SEQ ID NO: 4695)

CKAP5-1210 19 nt Target #3:  5'-AGAAAUUUGGACAAUAUGC-3'  (SEQ ID NO: 5271)

CKAP5-1212 19 nt Target #1:  5'-AUUUGGACAAUAUGCAGGA-3'  (SEQ ID NO: 4120)

CKAP5-1212 19 nt Target #2:  5'-AAUUUGGACAAUAUGCAGG-3'  (SEQ ID NO: 4696)

CKAP5-1212 19 nt Target #3:  5'-AAAUUUGGACAAUAUGCAG-3'  (SEQ ID NO: 5272)

CKAP5-1214 19 nt Target #1:  5'-UUGGACAAUAUGCAGGACA-3'  (SEQ ID NO: 4121)

CKAP5-1214 19 nt Target #2:  5'-UUUGGACAAUAUGCAGGAC-3'  (SEQ ID NO: 4697)

CKAP5-1214 19 nt Target #3:  5'-AUUUGGACAAUAUGCAGGA-3'  (SEQ ID NO: 5273)

CKAP5-1216 19 nt Target #1:  5'-GGACAAUAUGCAGGACAUG-3'  (SEQ ID NO: 4122)

CKAP5-1216 19 nt Target #2:  5'-UGGACAAUAUGCAGGACAU-3'  (SEQ ID NO: 4698)

CKAP5-1216 19 nt Target #3:  5'-UUGGACAAUAUGCAGGACA-3'  (SEQ ID NO: 5274)

CKAP5-1218 19 nt Target #1:  5'-ACAAUAUGCAGGACAUGUU-3'  (SEQ ID NO: 4123)

CKAP5-1218 19 nt Target #2:  5'-GACAAUAUGCAGGACAUGU-3'  (SEQ ID NO: 4699)

CKAP5-1218 19 nt Target #3:  5'-GGACAAUAUGCAGGACAUG-3'  (SEQ ID NO: 5275)

CKAP5-1220 19 nt Target #1:  5'-AAUAUGCAGGACAUGUUGU-3'  (SEQ ID NO: 4124)

CKAP5-1220 19 nt Target #2:  5'-CAAUAUGCAGGACAUGUUG-3'  (SEQ ID NO: 4700)

CKAP5-1220 19 nt Target #3:  5'-ACAAUAUGCAGGACAUGUU-3'  (SEQ ID NO: 5276)

CKAP5-1222 19 nt Target #1:  5'-UAUGCAGGACAUGUUGUGC-3'  (SEQ ID NO: 4125)

CKAP5-1222 19 nt Target #2:  5'-AUAUGCAGGACAUGUUGUG-3'  (SEQ ID NO: 4701)

CKAP5-1222 19 nt Target #3:  5'-AAUAUGCAGGACAUGUUGU-3'  (SEQ ID NO: 5277)

CKAP5-1224 19 nt Target #1:  5'-UGCAGGACAUGUUGUGCCA-3'  (SEQ ID NO: 4126)

CKAP5-1224 19 nt Target #2:  5'-AUGCAGGACAUGUUGUGCC-3'  (SEQ ID NO: 4702)

CKAP5-1224 19 nt Target #3:  5'-UAUGCAGGACAUGUUGUGC-3'  (SEQ ID NO: 5278)

CKAP5-1226 19 nt Target #1:  5'-CAGGACAUGUUGUGCCAAC-3'  (SEQ ID NO: 4127)

CKAP5-1226 19 nt Target #2:  5'-GCAGGACAUGUUGUGCCAA-3'  (SEQ ID NO: 4703)

CKAP5-1226 19 nt Target #3:  5'-UGCAGGACAUGUUGUGCCA-3'  (SEQ ID NO: 5279)

CKAP5-1274 19 nt Target #1:  5'-CUCAAGUGGUACAAGCCCU-3'  (SEQ ID NO: 4128)

CKAP5-1274 19 nt Target #2:  5'-CCUCAAGUGGUACAAGCCC-3'  (SEQ ID NO: 4704)

CKAP5-1274 19 nt Target #3:  5'-ACCUCAAGUGGUACAAGCC-3'  (SEQ ID NO: 5280)
```

TABLE 7-continued

DsiRNA Component 19 Nucleotide Target Sequences In CKAP5 mRNA

| | | |
|---|---|---|
| CKAP5-1276 19 nt Target #1: | 5'-CAAGUGGUACAAGCCCUGC-3' | (SEQ ID NO: 4129) |
| CKAP5-1276 19 nt Target #2: | 5'-UCAAGUGGUACAAGCCCUG-3' | (SEQ ID NO: 4705) |
| CKAP5-1276 19 nt Target #3: | 5'-CUCAAGUGGUACAAGCCCU-3' | (SEQ ID NO: 5281) |
| CKAP5-1278 19 nt Target #1: | 5'-AGUGGUACAAGCCCUGCAG-3' | (SEQ ID NO: 4130) |
| CKAP5-1278 19 nt Target #2: | 5'-AAGUGGUACAAGCCCUGCA-3' | (SEQ ID NO: 4706) |
| CKAP5-1278 19 nt Target #3: | 5'-CAAGUGGUACAAGCCCUGC-3' | (SEQ ID NO: 5282) |
| CKAP5-1280 19 nt Target #1: | 5'-UGGUACAAGCCCUGCAGGA-3' | (SEQ ID NO: 4131) |
| CKAP5-1280 19 nt Target #2: | 5'-GUGGUACAAGCCCUGCAGG-3' | (SEQ ID NO: 4707) |
| CKAP5-1280 19 nt Target #3: | 5'-AGUGGUACAAGCCCUGCAG-3' | (SEQ ID NO: 5283) |
| CKAP5-1282 19 nt Target #1: | 5'-GUACAAGCCCUGCAGGAGG-3' | (SEQ ID NO: 4132) |
| CKAP5-1282 19 nt Target #2: | 5'-GGUACAAGCCCUGCAGGAG-3' | (SEQ ID NO: 4708) |
| CKAP5-1282 19 nt Target #3: | 5'-UGGUACAAGCCCUGCAGGA-3' | (SEQ ID NO: 5284) |
| CKAP5-1284 19 nt Target #1: | 5'-ACAAGCCCUGCAGGAGGCA-3' | (SEQ ID NO: 4133) |
| CKAP5-1284 19 nt Target #2: | 5'-UACAAGCCCUGCAGGAGGC-3' | (SEQ ID NO: 4709) |
| CKAP5-1284 19 nt Target #3: | 5'-GUACAAGCCCUGCAGGAGG-3' | (SEQ ID NO: 5285) |
| CKAP5-1286 19 nt Target #1: | 5'-AAGCCCUGCAGGAGGCAAU-3' | (SEQ ID NO: 4134) |
| CKAP5-1286 19 nt Target #2: | 5'-CAAGCCCUGCAGGAGGCAA-3' | (SEQ ID NO: 4710) |
| CKAP5-1286 19 nt Target #3: | 5'-ACAAGCCCUGCAGGAGGCA-3' | (SEQ ID NO: 5286) |
| CKAP5-1288 19 nt Target #1: | 5'-GCCCUGCAGGAGGCAAUUG-3' | (SEQ ID NO: 4135) |
| CKAP5-1288 19 nt Target #2: | 5'-AGCCCUGCAGGAGGCAAUU-3' | (SEQ ID NO: 4711) |
| CKAP5-1288 19 nt Target #3: | 5'-AAGCCCUGCAGGAGGCAAU-3' | (SEQ ID NO: 5287) |
| CKAP5-1290 19 nt Target #1: | 5'-CCUGCAGGAGGCAAUUGAU-3' | (SEQ ID NO: 4136) |
| CKAP5-1290 19 nt Target #2: | 5'-CCCUGCAGGAGGCAAUUGA-3' | (SEQ ID NO: 4712) |
| CKAP5-1290 19 nt Target #3: | 5'-GCCCUGCAGGAGGCAAUUG-3' | (SEQ ID NO: 5288) |
| CKAP5-1292 19 nt Target #1: | 5'-UGCAGGAGGCAAUUGAUGC-3' | (SEQ ID NO: 4137) |
| CKAP5-1292 19 nt Target #2: | 5'-CUGCAGGAGGCAAUUGAUG-3' | (SEQ ID NO: 4713) |
| CKAP5-1292 19 nt Target #3: | 5'-CCUGCAGGAGGCAAUUGAU-3' | (SEQ ID NO: 5289) |
| CKAP5-1294 19 nt Target #1: | 5'-CAGGAGGCAAUUGAUGCAA-3' | (SEQ ID NO: 4138) |
| CKAP5-1294 19 nt Target #2: | 5'-GCAGGAGGCAAUUGAUGCA-3' | (SEQ ID NO: 4714) |
| CKAP5-1294 19 nt Target #3: | 5'-UGCAGGAGGCAAUUGAUGC-3' | (SEQ ID NO: 5290) |
| CKAP5-1296 19 nt Target #1: | 5'-GGAGGCAAUUGAUGCAAUC-3' | (SEQ ID NO: 4139) |
| CKAP5-1296 19 nt Target #2: | 5'-AGGAGGCAAUUGAUGCAAU-3' | (SEQ ID NO: 4715) |
| CKAP5-1296 19 nt Target #3: | 5'-CAGGAGGCAAUUGAUGCAA-3' | (SEQ ID NO: 5291) |
| CKAP5-1298 19 nt Target #1: | 5'-AGGCAAUUGAUGCAAUCUU-3' | (SEQ ID NO: 4140) |
| CKAP5-1298 19 nt Target #2: | 5'-GAGGCAAUUGAUGCAAUCU-3' | (SEQ ID NO: 4716) |
| CKAP5-1298 19 nt Target #3: | 5'-GGAGGCAAUUGAUGCAAUC-3' | (SEQ ID NO: 5292) |
| CKAP5-1300 19 nt Target #1: | 5'-GCAAUUGAUGCAAUCUUCC-3' | (SEQ ID NO: 4141) |
| CKAP5-1300 19 nt Target #2: | 5'-GGCAAUUGAUGCAAUCUUC-3' | (SEQ ID NO: 4717) |
| CKAP5-1300 19 nt Target #3: | 5'-AGGCAAUUGAUGCAAUCUU-3' | (SEQ ID NO: 5293) |

TABLE 7-continued

DsiRNA Component 19 Nucleotide Target Sequences In CKAP5 mRNA

| | | | |
|---|---|---|---|
| CKAP5-1321 19 nt Target #1: | 5'-ACUACCACACUACAGAACA-3' | (SEQ ID NO: 4142) |
| CKAP5-1321 19 nt Target #2: | 5'-UACUACCACACUACAGAAC-3' | (SEQ ID NO: 4718) |
| CKAP5-1321 19 nt Target #3: | 5'-UUACUACCACACUACAGAA-3' | (SEQ ID NO: 5294) |
| CKAP5-1323 19 nt Target #1: | 5'-UACCACACUACAGAACAUC-3' | (SEQ ID NO: 4143) |
| CKAP5-1323 19 nt Target #2: | 5'-CUACCACACUACAGAACAU-3' | (SEQ ID NO: 4719) |
| CKAP5-1323 19 nt Target #3: | 5'-ACUACCACACUACAGAACA-3' | (SEQ ID NO: 5295) |
| CKAP5-1325 19 nt Target #1: | 5'-CCACACUACAGAACAUCAG-3' | (SEQ ID NO: 4144) |
| CKAP5-1325 19 nt Target #2: | 5'-ACCACACUACAGAACAUCA-3' | (SEQ ID NO: 4720) |
| CKAP5-1325 19 nt Target #3: | 5'-UACCACACUACAGAACAUC-3' | (SEQ ID NO: 5296) |
| CKAP5-1327 19 nt Target #1: | 5'-ACACUACAGAACAUCAGUG-3' | (SEQ ID NO: 4145) |
| CKAP5-1327 19 nt Target #2: | 5'-CACACUACAGAACAUCAGU-3' | (SEQ ID NO: 4721) |
| CKAP5-1327 19 nt Target #3: | 5'-CCACACUACAGAACAUCAG-3' | (SEQ ID NO: 5297) |
| CKAP5-1329 19 nt Target #1: | 5'-ACUACAGAACAUCAGUGAG-3' | (SEQ ID NO: 4146) |
| CKAP5-1329 19 nt Target #2: | 5'-CACUACAGAACAUCAGUGA-3' | (SEQ ID NO: 4722) |
| CKAP5-1329 19 nt Target #3: | 5'-ACACUACAGAACAUCAGUG-3' | (SEQ ID NO: 5298) |
| CKAP5-1331 19 nt Target #1: | 5'-UACAGAACAUCAGUGAGGA-3' | (SEQ ID NO: 4147) |
| CKAP5-1331 19 nt Target #2: | 5'-CUACAGAACAUCAGUGAGG-3' | (SEQ ID NO: 4723) |
| CKAP5-1331 19 nt Target #3: | 5'-ACUACAGAACAUCAGUGAG-3' | (SEQ ID NO: 5299) |
| CKAP5-1333 19 nt Target #1: | 5'-CAGAACAUCAGUGAGGAUG-3' | (SEQ ID NO: 4148) |
| CKAP5-1333 19 nt Target #2: | 5'-ACAGAACAUCAGUGAGGAU-3' | (SEQ ID NO: 4724) |
| CKAP5-1333 19 nt Target #3: | 5'-UACAGAACAUCAGUGAGGA-3' | (SEQ ID NO: 5300) |
| CKAP5-1354 19 nt Target #1: | 5'-UUAGCAGUAAUGGAUAAUA-3' | (SEQ ID NO: 4149) |
| CKAP5-1354 19 nt Target #2: | 5'-UUUAGCAGUAAUGGAUAAU-3' | (SEQ ID NO: 4725) |
| CKAP5-1354 19 nt Target #3: | 5'-UUUUAGCAGUAAUGGAUAA-3' | (SEQ ID NO: 5301) |
| CKAP5-1356 19 nt Target #1: | 5'-AGCAGUAAUGGAUAAUAAA-3' | (SEQ ID NO: 4150) |
| CKAP5-1356 19 nt Target #2: | 5'-UAGCAGUAAUGGAUAAUAA-3' | (SEQ ID NO: 4726) |
| CKAP5-1356 19 nt Target #3: | 5'-UUAGCAGUAAUGGAUAAUA-3' | (SEQ ID NO: 5302) |
| CKAP5-1358 19 nt Target #1: | 5'-CAGUAAUGGAUAAUAAAAA-3' | (SEQ ID NO: 4151) |
| CKAP5-1358 19 nt Target #2: | 5'-GCAGUAAUGGAUAAUAAAA-3' | (SEQ ID NO: 4727) |
| CKAP5-1358 19 nt Target #3: | 5'-AGCAGUAAUGGAUAAUAAA-3' | (SEQ ID NO: 5303) |
| CKAP5-1360 19 nt Target #1: | 5'-GUAAUGGAUAAUAAAAAUC-3' | (SEQ ID NO: 4152) |
| CKAP5-1360 19 nt Target #2: | 5'-AGUAAUGGAUAAUAAAAAU-3' | (SEQ ID NO: 4728) |
| CKAP5-1360 19 nt Target #3: | 5'-CAGUAAUGGAUAAUAAAAA-3' | (SEQ ID NO: 5304) |
| CKAP5-1381 19 nt Target #1: | 5'-ACCAUCAAGCAGCAGACAU-3' | (SEQ ID NO: 4153) |
| CKAP5-1381 19 nt Target #2: | 5'-AACCAUCAAGCAGCAGACA-3' | (SEQ ID NO: 4729) |
| CKAP5-1381 19 nt Target #3: | 5'-CAACCAUCAAGCAGCAGAC-3' | (SEQ ID NO: 5305) |
| CKAP5-1480 19 nt Target #1: | 5'-CUACUUAAGCACAUCAAUG-3' | (SEQ ID NO: 4154) |
| CKAP5-1480 19 nt Target #2: | 5'-ACUACUUAAGCACAUCAAU-3' | (SEQ ID NO: 4730) |
| CKAP5-1480 19 nt Target #3: | 5'-CACUACUUAAGCACAUCAA-3' | (SEQ ID NO: 5306) |

TABLE 7-continued

DsiRNA Component 19 Nucleotide Target Sequences In CKAP5 mRNA

```
CKAP5-1482 19 nt Target #1:  5'-ACUUAAGCACAUCAAUGAU-3'   (SEQ ID NO: 4155)
CKAP5-1482 19 nt Target #2:  5'-UACUUAAGCACAUCAAUGA-3'   (SEQ ID NO: 4731)
CKAP5-1482 19 nt Target #3:  5'-CUACUUAAGCACAUCAAUG-3'   (SEQ ID NO: 5307)
CKAP5-1484 19 nt Target #1:  5'-UUAAGCACAUCAAUGAUUC-3'   (SEQ ID NO: 4156)
CKAP5-1484 19 nt Target #2:  5'-CUUAAGCACAUCAAUGAUU-3'   (SEQ ID NO: 4732)
CKAP5-1484 19 nt Target #3:  5'-ACUUAAGCACAUCAAUGAU-3'   (SEQ ID NO: 5308)
CKAP5-1486 19 nt Target #1:  5'-AAGCACAUCAAUGAUUCUG-3'   (SEQ ID NO: 4157)
CKAP5-1486 19 nt Target #2:  5'-UAAGCACAUCAAUGAUUCU-3'   (SEQ ID NO: 4733)
CKAP5-1486 19 nt Target #3:  5'-UUAAGCACAUCAAUGAUUC-3'   (SEQ ID NO: 5309)
CKAP5-1488 19 nt Target #1:  5'-GCACAUCAAUGAUUCUGCU-3'   (SEQ ID NO: 4158)
CKAP5-1488 19 nt Target #2:  5'-AGCACAUCAAUGAUUCUGC-3'   (SEQ ID NO: 4734)
CKAP5-1488 19 nt Target #3:  5'-AAGCACAUCAAUGAUUCUG-3'   (SEQ ID NO: 5310)
CKAP5-1490 19 nt Target #1:  5'-ACAUCAAUGAUUCUGCUCC-3'   (SEQ ID NO: 4159)
CKAP5-1490 19 nt Target #2:  5'-CACAUCAAUGAUUCUGCUC-3'   (SEQ ID NO: 4735)
CKAP5-1490 19 nt Target #3:  5'-GCACAUCAAUGAUUCUGCU-3'   (SEQ ID NO: 5311)
CKAP5-1492 19 nt Target #1:  5'-AUCAAUGAUUCUGCUCCUG-3'   (SEQ ID NO: 4160)
CKAP5-1492 19 nt Target #2:  5'-CAUCAAUGAUUCUGCUCCU-3'   (SEQ ID NO: 4736)
CKAP5-1492 19 nt Target #3:  5'-ACAUCAAUGAUUCUGCUCC-3'   (SEQ ID NO: 5312)
CKAP5-1494 19 nt Target #1:  5'-CAAUGAUUCUGCUCCUGAA-3'   (SEQ ID NO: 4161)
CKAP5-1494 19 nt Target #2:  5'-UCAAUGAUUCUGCUCCUGA-3'   (SEQ ID NO: 4737)
CKAP5-1494 19 nt Target #3:  5'-AUCAAUGAUUCUGCUCCUG-3'   (SEQ ID NO: 5313)
CKAP5-1496 19 nt Target #1:  5'-AUGAUUCUGCUCCUGAAGU-3'   (SEQ ID NO: 4162)
CKAP5-1496 19 nt Target #2:  5'-AAUGAUUCUGCUCCUGAAG-3'   (SEQ ID NO: 4738)
CKAP5-1496 19 nt Target #3:  5'-CAAUGAUUCUGCUCCUGAA-3'   (SEQ ID NO: 5314)
CKAP5-1498 19 nt Target #1:  5'-GAUUCUGCUCCUGAAGUCA-3'   (SEQ ID NO: 4163)
CKAP5-1498 19 nt Target #2:  5'-UGAUUCUGCUCCUGAAGUC-3'   (SEQ ID NO: 4739)
CKAP5-1498 19 nt Target #3:  5'-AUGAUUCUGCUCCUGAAGU-3'   (SEQ ID NO: 5315)
CKAP5-1500 19 nt Target #1:  5'-UUCUGCUCCUGAAGUCAGA-3'   (SEQ ID NO: 4164)
CKAP5-1500 19 nt Target #2:  5'-AUUCUGCUCCUGAAGUCAG-3'   (SEQ ID NO: 4740)
CKAP5-1500 19 nt Target #3:  5'-GAUUCUGCUCCUGAAGUCA-3'   (SEQ ID NO: 5316)
CKAP5-1502 19 nt Target #1:  5'-CUGCUCCUGAAGUCAGAGA-3'   (SEQ ID NO: 4165)
CKAP5-1502 19 nt Target #2:  5'-UCUGCUCCUGAAGUCAGAG-3'   (SEQ ID NO: 4741)
CKAP5-1502 19 nt Target #3:  5'-UUCUGCUCCUGAAGUCAGA-3'   (SEQ ID NO: 5317)
CKAP5-1504 19 nt Target #1:  5'-GCUCCUGAAGUCAGAGAUG-3'   (SEQ ID NO: 4166)
CKAP5-1504 19 nt Target #2:  5'-UGCUCCUGAAGUCAGAGAU-3'   (SEQ ID NO: 4742)
CKAP5-1504 19 nt Target #3:  5'-CUGCUCCUGAAGUCAGAGA-3'   (SEQ ID NO: 5318)
CKAP5-1617 19 nt Target #1:  5'-GAUCAAAGAAUGUUCAGAA-3'   (SEQ ID NO: 4167)
CKAP5-1617 19 nt Target #2:  5'-AGAUCAAAGAAUGUUCAGA-3'   (SEQ ID NO: 4743)
CKAP5-1617 19 nt Target #3:  5'-AAGAUCAAAGAAUGUUCAG-3'   (SEQ ID NO: 5319)
```

TABLE 7-continued

DsiRNA Component 19 Nucleotide Target Sequences In CKAP5 mRNA

| | | |
|---|---|---|
| CKAP5-1619 19 nt Target #1: | 5'-UCAAAGAAUGUUCAGAAAA-3' | (SEQ ID NO: 4168) |
| CKAP5-1619 19 nt Target #2: | 5'-AUCAAAGAAUGUUCAGAAA-3' | (SEQ ID NO: 4744) |
| CKAP5-1619 19 nt Target #3: | 5'-GAUCAAAGAAUGUUCAGAA-3' | (SEQ ID NO: 5320) |
| CKAP5-2090 19 nt Target #1: | 5'-AACCUGGAUGGAAAGAAAC-3' | (SEQ ID NO: 4169) |
| CKAP5-2090 19 nt Target #2: | 5'-AAACCUGGAUGGAAAGAAA-3' | (SEQ ID NO: 4745) |
| CKAP5-2090 19 nt Target #3: | 5'-GAAACCUGGAUGGAAAGAA-3' | (SEQ ID NO: 5321) |
| CKAP5-2092 19 nt Target #1: | 5'-CCUGGAUGGAAAGAAACUA-3' | (SEQ ID NO: 4170) |
| CKAP5-2092 19 nt Target #2: | 5'-ACCUGGAUGGAAAGAAACU-3' | (SEQ ID NO: 4746) |
| CKAP5-2092 19 nt Target #3: | 5'-AACCUGGAUGGAAAGAAAC-3' | (SEQ ID NO: 5322) |
| CKAP5-2094 19 nt Target #1: | 5'-UGGAUGGAAAGAAACUAAU-3' | (SEQ ID NO: 4171) |
| CKAP5-2094 19 nt Target #2: | 5'-CUGGAUGGAAAGAAACUAA-3' | (SEQ ID NO: 4747) |
| CKAP5-2094 19 nt Target #3: | 5'-CCUGGAUGGAAAGAAACUA-3' | (SEQ ID NO: 5323) |
| CKAP5-2096 19 nt Target #1: | 5'-GAUGGAAAGAAACUAAUUU-3' | (SEQ ID NO: 4172) |
| CKAP5-2096 19 nt Target #2: | 5'-GGAUGGAAAGAAACUAAUU-3' | (SEQ ID NO: 4748) |
| CKAP5-2096 19 nt Target #3: | 5'-UGGAUGGAAAGAAACUAAU-3' | (SEQ ID NO: 5324) |
| CKAP5-2098 19 nt Target #1: | 5'-UGGAAAGAAACUAAUUUUC-3' | (SEQ ID NO: 4173) |
| CKAP5-2098 19 nt Target #2: | 5'-AUGGAAAGAAACUAAUUUU-3' | (SEQ ID NO: 4749) |
| CKAP5-2098 19 nt Target #3: | 5'-GAUGGAAAGAAACUAAUUU-3' | (SEQ ID NO: 5325) |
| CKAP5-2100 19 nt Target #1: | 5'-GAAAGAAACUAAUUUUCAG-3' | (SEQ ID NO: 4174) |
| CKAP5-2100 19 nt Target #2: | 5'-GGAAAGAAACUAAUUUUCA-3' | (SEQ ID NO: 4750) |
| CKAP5-2100 19 nt Target #3: | 5'-UGGAAAGAAACUAAUUUUC-3' | (SEQ ID NO: 5326) |
| CKAP5-2102 19 nt Target #1: | 5'-AAGAAACUAAUUUUCAGGU-3' | (SEQ ID NO: 4175) |
| CKAP5-2102 19 nt Target #2: | 5'-AAAGAAACUAAUUUUCAGG-3' | (SEQ ID NO: 4751) |
| CKAP5-2102 19 nt Target #3: | 5'-GAAAGAAACUAAUUUUCAG-3' | (SEQ ID NO: 5327) |
| CKAP5-2104 19 nt Target #1: | 5'-GAAACUAAUUUUCAGGUGA-3' | (SEQ ID NO: 4176) |
| CKAP5-2104 19 nt Target #2: | 5'-AGAAACUAAUUUUCAGGUG-3' | (SEQ ID NO: 4752) |
| CKAP5-2104 19 nt Target #3: | 5'-AAGAAACUAAUUUUCAGGU-3' | (SEQ ID NO: 5328) |
| CKAP5-2106 19 nt Target #1: | 5'-AACUAAUUUUCAGGUGAUG-3' | (SEQ ID NO: 4177) |
| CKAP5-2106 19 nt Target #2: | 5'-AAACUAAUUUUCAGGUGAU-3' | (SEQ ID NO: 4753) |
| CKAP5-2106 19 nt Target #3: | 5'-GAAACUAAUUUUCAGGUGA-3' | (SEQ ID NO: 5329) |
| CKAP5-2108 19 nt Target #1: | 5'-CUAAUUUUCAGGUGAUGCA-3' | (SEQ ID NO: 4178) |
| CKAP5-2108 19 nt Target #2: | 5'-ACUAAUUUUCAGGUGAUGC-3' | (SEQ ID NO: 4754) |
| CKAP5-2108 19 nt Target #3: | 5'-AACUAAUUUUCAGGUGAUG-3' | (SEQ ID NO: 5330) |
| CKAP5-2144 19 nt Target #1: | 5'-UUGCUUUGAUUGCCCAGAA-3' | (SEQ ID NO: 4179) |
| CKAP5-2144 19 nt Target #2: | 5'-GUUGCUUUGAUUGCCCAGA-3' | (SEQ ID NO: 4755) |
| CKAP5-2144 19 nt Target #3: | 5'-AGUUGCUUUGAUUGCCCAG-3' | (SEQ ID NO: 5331) |
| CKAP5-2146 19 nt Target #1: | 5'-GCUUUGAUUGCCCAGAAGG-3' | (SEQ ID NO: 4180) |
| CKAP5-2146 19 nt Target #2: | 5'-UGCUUUGAUUGCCCAGAAG-3' | (SEQ ID NO: 4756) |
| CKAP5-2146 19 nt Target #3: | 5'-UUGCUUUGAUUGCCCAGAA-3' | (SEQ ID NO: 5332) |

TABLE 7-continued

DsiRNA Component 19 Nucleotide Target Sequences In CKAP5 mRNA

| | | |
|---|---|---|
| CKAP5-2148 19 nt Target #1: | 5'-UUUGAUUGCCCAGAAGGGA-3' | (SEQ ID NO: 4181) |
| CKAP5-2148 19 nt Target #2: | 5'-CUUUGAUUGCCCAGAAGGG-3' | (SEQ ID NO: 4757) |
| CKAP5-2148 19 nt Target #3: | 5'-GCUUUGAUUGCCCAGAAGG-3' | (SEQ ID NO: 5333) |
| CKAP5-2150 19 nt Target #1: | 5'-UGAUUGCCCAGAAGGGAAA-3' | (SEQ ID NO: 4182) |
| CKAP5-2150 19 nt Target #2: | 5'-UUGAUUGCCCAGAAGGGAA-3' | (SEQ ID NO: 4758) |
| CKAP5-2150 19 nt Target #3: | 5'-UUUGAUUGCCCAGAAGGGA-3' | (SEQ ID NO: 5334) |
| CKAP5-2152 19 nt Target #1: | 5'-AUUGCCCAGAAGGGAAAUU-3' | (SEQ ID NO: 4183) |
| CKAP5-2152 19 nt Target #2: | 5'-GAUUGCCCAGAAGGGAAAU-3' | (SEQ ID NO: 4759) |
| CKAP5-2152 19 nt Target #3: | 5'-UGAUUGCCCAGAAGGGAAA-3' | (SEQ ID NO: 5335) |
| CKAP5-2154 19 nt Target #1: | 5'-UGCCCAGAAGGGAAAUUUU-3' | (SEQ ID NO: 4184) |
| CKAP5-2154 19 nt Target #2: | 5'-UUGCCCAGAAGGGAAAUUU-3' | (SEQ ID NO: 4760) |
| CKAP5-2154 19 nt Target #3: | 5'-AUUGCCCAGAAGGGAAAUU-3' | (SEQ ID NO: 5336) |
| CKAP5-2156 19 nt Target #1: | 5'-CCCAGAAGGGAAAUUUUC-3' | (SEQ ID NO: 4185) |
| CKAP5-2156 19 nt Target #2: | 5'-GCCCAGAAGGGAAAUUUUU-3' | (SEQ ID NO: 4761) |
| CKAP5-2156 19 nt Target #3: | 5'-UGCCCAGAAGGGAAAUUUU-3' | (SEQ ID NO: 5337) |
| CKAP5-2212 19 nt Target #1: | 5'-GACAAGAUUGGAGAUGUGA-3' | (SEQ ID NO: 4186) |
| CKAP5-2212 19 nt Target #2: | 5'-GGACAAGAUUGGAGAUGUG-3' | (SEQ ID NO: 4762) |
| CKAP5-2212 19 nt Target #3: | 5'-UGGACAAGAUUGGAGAUGU-3' | (SEQ ID NO: 5338) |
| CKAP5-2214 19 nt Target #1: | 5'-CAAGAUUGGAGAUGUGAAA-3' | (SEQ ID NO: 4187) |
| CKAP5-2214 19 nt Target #2: | 5'-ACAAGAUUGGAGAUGUGAA-3' | (SEQ ID NO: 4763) |
| CKAP5-2214 19 nt Target #3: | 5'-GACAAGAUUGGAGAUGUGA-3' | (SEQ ID NO: 5339) |
| CKAP5-2216 19 nt Target #1: | 5'-AGAUUGGAGAUGUGAAAUG-3' | (SEQ ID NO: 4188) |
| CKAP5-2216 19 nt Target #2: | 5'-AAGAUUGGAGAUGUGAAAU-3' | (SEQ ID NO: 4764) |
| CKAP5-2216 19 nt Target #3: | 5'-CAAGAUUGGAGAUGUGAAA-3' | (SEQ ID NO: 5340) |
| CKAP5-2218 19 nt Target #1: | 5'-AUUGGAGAUGUGAAAUGUG-3' | (SEQ ID NO: 4189) |
| CKAP5-2218 19 nt Target #2: | 5'-GAUUGGAGAUGUGAAAUGU-3' | (SEQ ID NO: 4765) |
| CKAP5-2218 19 nt Target #3: | 5'-AGAUUGGAGAUGUGAAAUG-3' | (SEQ ID NO: 5341) |
| CKAP5-2220 19 nt Target #1: | 5'-UGGAGAUGUGAAAUGUGGG-3' | (SEQ ID NO: 4190) |
| CKAP5-2220 19 nt Target #2: | 5'-UUGGAGAUGUGAAAUGUGG-3' | (SEQ ID NO: 4766) |
| CKAP5-2220 19 nt Target #3: | 5'-AUUGGAGAUGUGAAAUGUG-3' | (SEQ ID NO: 5342) |
| CKAP5-2222 19 nt Target #1: | 5'-GAGAUGUGAAAUGUGGGAA-3' | (SEQ ID NO: 4191) |
| CKAP5-2222 19 nt Target #2: | 5'-GGAGAUGUGAAAUGUGGGA-3' | (SEQ ID NO: 4767) |
| CKAP5-2222 19 nt Target #3: | 5'-UGGAGAUGUGAAAUGUGGG-3' | (SEQ ID NO: 5343) |
| CKAP5-2224 19 nt Target #1: | 5'-GAUGUGAAAUGUGGGAACA-3' | (SEQ ID NO: 4192) |
| CKAP5-2224 19 nt Target #2: | 5'-AGAUGUGAAAUGUGGGAAC-3' | (SEQ ID NO: 4768) |
| CKAP5-2224 19 nt Target #3: | 5'-GAGAUGUGAAAUGUGGGAA-3' | (SEQ ID NO: 5344) |
| CKAP5-2226 19 nt Target #1: | 5'-UGUGAAAUGUGGGAACAAU-3' | (SEQ ID NO: 4193) |
| CKAP5-2226 19 nt Target #2: | 5'-AUGUGAAAUGUGGGAACAA-3' | (SEQ ID NO: 4769) |
| CKAP5-2226 19 nt Target #3: | 5'-GAUGUGAAAUGUGGGAACA-3' | (SEQ ID NO: 5345) |

TABLE 7-continued

DsiRNA Component 19 Nucleotide Target Sequences In CKAP5 mRNA

| | | |
|---|---|---|
| CKAP5-2228 19 nt Target #1: | 5'-UGAAAUGUGGGAACAAUGC-3' | (SEQ ID NO: 4194) |
| CKAP5-2228 19 nt Target #2: | 5'-GUGAAAUGUGGGAACAAUG-3' | (SEQ ID NO: 4770) |
| CKAP5-2228 19 nt Target #3: | 5'-UGUGAAAUGUGGGAACAAU-3' | (SEQ ID NO: 5346) |
| CKAP5-2230 19 nt Target #1: | 5'-AAAUGUGGGAACAAUGCAA-3' | (SEQ ID NO: 4195) |
| CKAP5-2230 19 nt Target #2: | 5'-GAAAUGUGGGAACAAUGCA-3' | (SEQ ID NO: 4771) |
| CKAP5-2230 19 nt Target #3: | 5'-UGAAAUGUGGGAACAAUGC-3' | (SEQ ID NO: 5347) |
| CKAP5-2232 19 nt Target #1: | 5'-AUGUGGGAACAAUGCAAAA-3' | (SEQ ID NO: 4196) |
| CKAP5-2232 19 nt Target #2: | 5'-AAUGUGGGAACAAUGCAAA-3' | (SEQ ID NO: 4772) |
| CKAP5-2232 19 nt Target #3: | 5'-AAAUGUGGGAACAAUGCAA-3' | (SEQ ID NO: 5348) |
| CKAP5-2234 19 nt Target #1: | 5'-GUGGGAACAAUGCAAAAGA-3' | (SEQ ID NO: 4197) |
| CKAP5-2234 19 nt Target #2: | 5'-UGUGGGAACAAUGCAAAAG-3' | (SEQ ID NO: 4773) |
| CKAP5-2234 19 nt Target #3: | 5'-AUGUGGGAACAAUGCAAAA-3' | (SEQ ID NO: 5349) |
| CKAP5-2236 19 nt Target #1: | 5'-GGGAACAAUGCAAAAGAAG-3' | (SEQ ID NO: 4198) |
| CKAP5-2236 19 nt Target #2: | 5'-UGGGAACAAUGCAAAAGAA-3' | (SEQ ID NO: 4774) |
| CKAP5-2236 19 nt Target #3: | 5'-GUGGGAACAAUGCAAAAGA-3' | (SEQ ID NO: 5350) |
| CKAP5-2400 19 nt Target #1: | 5'-GUUGAAUGUCAAAGCUUUC-3' | (SEQ ID NO: 4199) |
| CKAP5-2400 19 nt Target #2: | 5'-GGUUGAAUGUCAAAGCUUU-3' | (SEQ ID NO: 4775) |
| CKAP5-2400 19 nt Target #3: | 5'-GGGUUGAAUGUCAAAGCUU-3' | (SEQ ID NO: 5351) |
| CKAP5-2402 19 nt Target #1: | 5'-UGAAUGUCAAAGCUUUCAU-3' | (SEQ ID NO: 4200) |
| CKAP5-2402 19 nt Target #2: | 5'-UUGAAUGUCAAAGCUUUCA-3' | (SEQ ID NO: 4776) |
| CKAP5-2402 19 nt Target #3: | 5'-GUUGAAUGUCAAAGCUUUC-3' | (SEQ ID NO: 5352) |
| CKAP5-2404 19 nt Target #1: | 5'-AAUGUCAAAGCUUUCAUUA-3' | (SEQ ID NO: 4201) |
| CKAP5-2404 19 nt Target #2: | 5'-GAAUGUCAAAGCUUUCAUU-3' | (SEQ ID NO: 4777) |
| CKAP5-2404 19 nt Target #3: | 5'-UGAAUGUCAAAGCUUUCAU-3' | (SEQ ID NO: 5353) |
| CKAP5-2406 19 nt Target #1: | 5'-UGUCAAAGCUUUCAUUAGC-3' | (SEQ ID NO: 4202) |
| CKAP5-2406 19 nt Target #2: | 5'-AUGUCAAAGCUUUCAUUAG-3' | (SEQ ID NO: 4778) |
| CKAP5-2406 19 nt Target #3: | 5'-AAUGUCAAAGCUUUCAUUA-3' | (SEQ ID NO: 5354) |
| CKAP5-2408 19 nt Target #1: | 5'-UCAAAGCUUUCAUUAGCAA-3' | (SEQ ID NO: 4203) |
| CKAP5-2408 19 nt Target #2: | 5'-GUCAAAGCUUUCAUUAGCA-3' | (SEQ ID NO: 4779) |
| CKAP5-2408 19 nt Target #3: | 5'-UGUCAAAGCUUUCAUUAGC-3' | (SEQ ID NO: 5355) |
| CKAP5-2480 19 nt Target #1: | 5'-CCCUGCUUGGCGUGAUGUA-3' | (SEQ ID NO: 4204) |
| CKAP5-2480 19 nt Target #2: | 5'-ACCCUGCUUGGCGUGAUGU-3' | (SEQ ID NO: 4780) |
| CKAP5-2480 19 nt Target #3: | 5'-AACCCUGCUUGGCGUGAUG-3' | (SEQ ID NO: 5356) |
| CKAP5-2482 19 nt Target #1: | 5'-CUGCUUGGCGUGAUGUAUC-3' | (SEQ ID NO: 4205) |
| CKAP5-2482 19 nt Target #2: | 5'-CCUGCUUGGCGUGAUGUAU-3' | (SEQ ID NO: 4781) |
| CKAP5-2482 19 nt Target #3: | 5'-CCCUGCUUGGCGUGAUGUA-3' | (SEQ ID NO: 5357) |
| CKAP5-2528 19 nt Target #1: | 5'-UCUUUGAGGAUGAGAAGCC-3' | (SEQ ID NO: 4206) |
| CKAP5-2528 19 nt Target #2: | 5'-UUCUUUGAGGAUGAGAAGC-3' | (SEQ ID NO: 4782) |
| CKAP5-2528 19 nt Target #3: | 5'-GUUCUUUGAGGAUGAGAAG-3' | (SEQ ID NO: 5358) |

TABLE 7-continued

DsiRNA Component 19 Nucleotide Target Sequences In CKAP5 mRNA

| | | |
|---|---|---|
| CKAP5-2530 19 nt Target #1: | 5'-UUUGAGGAUGAGAAGCCUG-3' | (SEQ ID NO: 4207) |
| CKAP5-2530 19 nt Target #2: | 5'-CUUUGAGGAUGAGAAGCCU-3' | (SEQ ID NO: 4783) |
| CKAP5-2530 19 nt Target #3: | 5'-UCUUUGAGGAUGAGAAGCC-3' | (SEQ ID NO: 5359) |
| CKAP5-2532 19 nt Target #1: | 5'-UGAGGAUGAGAAGCCUGCC-3' | (SEQ ID NO: 4208) |
| CKAP5-2532 19 nt Target #2: | 5'-UUGAGGAUGAGAAGCCUGC-3' | (SEQ ID NO: 4784) |
| CKAP5-2532 19 nt Target #3: | 5'-UUUGAGGAUGAGAAGCCUG-3' | (SEQ ID NO: 5360) |
| CKAP5-2534 19 nt Target #1: | 5'-AGGAUGAGAAGCCUGCCCU-3' | (SEQ ID NO: 4209) |
| CKAP5-2534 19 nt Target #2: | 5'-GAGGAUGAGAAGCCUGCCC-3' | (SEQ ID NO: 4785) |
| CKAP5-2534 19 nt Target #3: | 5'-UGAGGAUGAGAAGCCUGCC-3' | (SEQ ID NO: 5361) |
| CKAP5-2536 19 nt Target #1: | 5'-GAUGAGAAGCCUGCCCUCC-3' | (SEQ ID NO: 4210) |
| CKAP5-2536 19 nt Target #2: | 5'-GGAUGAGAAGCCUGCCCUC-3' | (SEQ ID NO: 4786) |
| CKAP5-2536 19 nt Target #3: | 5'-AGGAUGAGAAGCCUGCCCU-3' | (SEQ ID NO: 5362) |
| CKAP5-2538 19 nt Target #1: | 5'-UGAGAAGCCUGCCCUCCUA-3' | (SEQ ID NO: 4211) |
| CKAP5-2538 19 nt Target #2: | 5'-AUGAGAAGCCUGCCCUCCU-3' | (SEQ ID NO: 4787) |
| CKAP5-2538 19 nt Target #3: | 5'-GAUGAGAAGCCUGCCCUCC-3' | (SEQ ID NO: 5363) |
| CKAP5-2540 19 nt Target #1: | 5'-AGAAGCCUGCCCUCCUAUC-3' | (SEQ ID NO: 4212) |
| CKAP5-2540 19 nt Target #2: | 5'-GAGAAGCCUGCCCUCCUAU-3' | (SEQ ID NO: 4788) |
| CKAP5-2540 19 nt Target #3: | 5'-UGAGAAGCCUGCCCUCCUA-3' | (SEQ ID NO: 5364) |
| CKAP5-2542 19 nt Target #1: | 5'-AAGCCUGCCCUCCUAUCCC-3' | (SEQ ID NO: 4213) |
| CKAP5-2542 19 nt Target #2: | 5'-GAAGCCUGCCCUCCUAUCC-3' | (SEQ ID NO: 4789) |
| CKAP5-2542 19 nt Target #3: | 5'-AGAAGCCUGCCCUCCUAUC-3' | (SEQ ID NO: 5365) |
| CKAP5-2544 19 nt Target #1: | 5'-GCCUGCCCUCCUAUCCCAG-3' | (SEQ ID NO: 4214) |
| CKAP5-2544 19 nt Target #2: | 5'-AGCCUGCCCUCCUAUCCCA-3' | (SEQ ID NO: 4790) |
| CKAP5-2544 19 nt Target #3: | 5'-AAGCCUGCCCUCCUAUCCC-3' | (SEQ ID NO: 5366) |
| CKAP5-2546 19 nt Target #1: | 5'-CUGCCCUCCUAUCCCAGAU-3' | (SEQ ID NO: 4215) |
| CKAP5-2546 19 nt Target #2: | 5'-CCUGCCCUCCUAUCCCAGA-3' | (SEQ ID NO: 4791) |
| CKAP5-2546 19 nt Target #3: | 5'-GCCUGCCCUCCUAUCCCAG-3' | (SEQ ID NO: 5367) |
| CKAP5-2548 19 nt Target #1: | 5'-GCCCUCCUAUCCCAGAUAG-3' | (SEQ ID NO: 4216) |
| CKAP5-2548 19 nt Target #2: | 5'-UGCCCUCCUAUCCCAGAUA-3' | (SEQ ID NO: 4792) |
| CKAP5-2548 19 nt Target #3: | 5'-CUGCCCUCCUAUCCCAGAU-3' | (SEQ ID NO: 5368) |
| CKAP5-2550 19 nt Target #1: | 5'-CCUCCUAUCCCAGAUAGAU-3' | (SEQ ID NO: 4217) |
| CKAP5-2550 19 nt Target #2: | 5'-CCCUCCUAUCCCAGAUAGA-3' | (SEQ ID NO: 4793) |
| CKAP5-2550 19 nt Target #3: | 5'-GCCCUCCUAUCCCAGAUAG-3' | (SEQ ID NO: 5369) |
| CKAP5-2552 19 nt Target #1: | 5'-UCCUAUCCCAGAUAGAUGC-3' | (SEQ ID NO: 4218) |
| CKAP5-2552 19 nt Target #2: | 5'-CUCCUAUCCCAGAUAGAUG-3' | (SEQ ID NO: 4794) |
| CKAP5-2552 19 nt Target #3: | 5'-CCUCCUAUCCCAGAUAGAU-3' | (SEQ ID NO: 5370) |
| CKAP5-2554 19 nt Target #1: | 5'-CUAUCCCAGAUAGAUGCAG-3' | (SEQ ID NO: 4219) |
| CKAP5-2554 19 nt Target #2: | 5'-CCUAUCCCAGAUAGAUGCA-3' | (SEQ ID NO: 4795) |
| CKAP5-2554 19 nt Target #3: | 5'-UCCUAUCCCAGAUAGAUGC-3' | (SEQ ID NO: 5371) |

TABLE 7-continued

DsiRNA Component 19 Nucleotide Target Sequences In CKAP5 mRNA

| | | |
|---|---|---|
| CKAP5-2556 19 nt Target #1: | 5'-AUCCCAGAUAGAUGCAGAA-3' | (SEQ ID NO: 4220) |
| CKAP5-2556 19 nt Target #2: | 5'-UAUCCCAGAUAGAUGCAGA-3' | (SEQ ID NO: 4796) |
| CKAP5-2556 19 nt Target #3: | 5'-CUAUCCCAGAUAGAUGCAG-3' | (SEQ ID NO: 5372) |
| CKAP5-2558 19 nt Target #1: | 5'-CCCAGAUAGAUGCAGAAUU-3' | (SEQ ID NO: 4221) |
| CKAP5-2558 19 nt Target #2: | 5'-UCCCAGAUAGAUGCAGAAU-3' | (SEQ ID NO: 4797) |
| CKAP5-2558 19 nt Target #3: | 5'-AUCCCAGAUAGAUGCAGAA-3' | (SEQ ID NO: 5373) |
| CKAP5-2581 19 nt Target #1: | 5'-AAGAUGCAGGGACAAAGUC-3' | (SEQ ID NO: 4222) |
| CKAP5-2581 19 nt Target #2: | 5'-GAAGAUGCAGGGACAAAGU-3' | (SEQ ID NO: 4798) |
| CKAP5-2581 19 nt Target #3: | 5'-AGAAGAUGCAGGGACAAAG-3' | (SEQ ID NO: 5374) |
| CKAP5-2643 19 nt Target #1: | 5'-UACAGAUGAAGGAGAAGAU-3' | (SEQ ID NO: 4223) |
| CKAP5-2643 19 nt Target #2: | 5'-GUACAGAUGAAGGAGAAGA-3' | (SEQ ID NO: 4799) |
| CKAP5-2643 19 nt Target #3: | 5'-GGUACAGAUGAAGGAGAAG-3' | (SEQ ID NO: 5375) |
| CKAP5-2645 19 nt Target #1: | 5'-CAGAUGAAGGAGAAGAUGG-3' | (SEQ ID NO: 4224) |
| CKAP5-2645 19 nt Target #2: | 5'-ACAGAUGAAGGAGAAGAUG-3' | (SEQ ID NO: 4800) |
| CKAP5-2645 19 nt Target #3: | 5'-UACAGAUGAAGGAGAAGAU-3' | (SEQ ID NO: 5376) |
| CKAP5-2647 19 nt Target #1: | 5'-GAUGAAGGAGAAGAUGGAG-3' | (SEQ ID NO: 4225) |
| CKAP5-2647 19 nt Target #2: | 5'-AGAUGAAGGAGAAGAUGGA-3' | (SEQ ID NO: 4801) |
| CKAP5-2647 19 nt Target #3: | 5'-CAGAUGAAGGAGAAGAUGG-3' | (SEQ ID NO: 5377) |
| CKAP5-2695 19 nt Target #1: | 5'-GUUGAUCUUUUGCCGAGGA-3' | (SEQ ID NO: 4226) |
| CKAP5-2695 19 nt Target #2: | 5'-CGUUGAUCUUUUGCCGAGG-3' | (SEQ ID NO: 4802) |
| CKAP5-2695 19 nt Target #3: | 5'-UCGUUGAUCUUUUGCCGAG-3' | (SEQ ID NO: 5378) |
| CKAP5-2780 19 nt Target #1: | 5'-GGAAAGAAGGCCUAGAUGA-3' | (SEQ ID NO: 4227) |
| CKAP5-2780 19 nt Target #2: | 5'-AGGAAAGAAGGCCUAGAUG-3' | (SEQ ID NO: 4803) |
| CKAP5-2780 19 nt Target #3: | 5'-UAGGAAAGAAGGCCUAGAU-3' | (SEQ ID NO: 5379) |
| CKAP5-2782 19 nt Target #1: | 5'-AAAGAAGGCCUAGAUGAAG-3' | (SEQ ID NO: 4228) |
| CKAP5-2782 19 nt Target #2: | 5'-GAAAGAAGGCCUAGAUGAA-3' | (SEQ ID NO: 4804) |
| CKAP5-2782 19 nt Target #3: | 5'-GGAAAGAAGGCCUAGAUGA-3' | (SEQ ID NO: 5380) |
| CKAP5-2784 19 nt Target #1: | 5'-AGAAGGCCUAGAUGAAGUG-3' | (SEQ ID NO: 4229) |
| CKAP5-2784 19 nt Target #2: | 5'-AAGAAGGCCUAGAUGAAGU-3' | (SEQ ID NO: 4805) |
| CKAP5-2784 19 nt Target #3: | 5'-AAAGAAGGCCUAGAUGAAG-3' | (SEQ ID NO: 5381) |
| CKAP5-2786 19 nt Target #1: | 5'-AAGGCCUAGAUGAAGUGGC-3' | (SEQ ID NO: 4230) |
| CKAP5-2786 19 nt Target #2: | 5'-GAAGGCCUAGAUGAAGUGG-3' | (SEQ ID NO: 4806) |
| CKAP5-2786 19 nt Target #3: | 5'-AGAAGGCCUAGAUGAAGUG-3' | (SEQ ID NO: 5382) |
| CKAP5-2788 19 nt Target #1: | 5'-GGCCUAGAUGAAGUGGCAG-3' | (SEQ ID NO: 4231) |
| CKAP5-2788 19 nt Target #2: | 5'-AGGCCUAGAUGAAGUGGCA-3' | (SEQ ID NO: 4807) |
| CKAP5-2788 19 nt Target #3: | 5'-AAGGCCUAGAUGAAGUGGC-3' | (SEQ ID NO: 5383) |
| CKAP5-2790 19 nt Target #1: | 5'-CCUAGAUGAAGUGGCAGGU-3' | (SEQ ID NO: 4232) |
| CKAP5-2790 19 nt Target #2: | 5'-GCCUAGAUGAAGUGGCAGG-3' | (SEQ ID NO: 4808) |
| CKAP5-2790 19 nt Target #3: | 5'-GGCCUAGAUGAAGUGGCAG-3' | (SEQ ID NO: 5384) |

TABLE 7-continued

DsiRNA Component 19 Nucleotide Target Sequences In CKAP5 mRNA

| | | |
|---|---|---|
| CKAP5-2792 19 nt Target #1: | 5'-UAGAUGAAGUGGCAGGUAU-3' | (SEQ ID NO: 4233) |
| CKAP5-2792 19 nt Target #2: | 5'-CUAGAUGAAGUGGCAGGUA-3' | (SEQ ID NO: 4809) |
| CKAP5-2792 19 nt Target #3: | 5'-CCUAGAUGAAGUGGCAGGU-3' | (SEQ ID NO: 5385) |
| CKAP5-2794 19 nt Target #1: | 5'-GAUGAAGUGGCAGGUAUUA-3' | (SEQ ID NO: 4234) |
| CKAP5-2794 19 nt Target #2: | 5'-AGAUGAAGUGGCAGGUAUU-3' | (SEQ ID NO: 4810) |
| CKAP5-2794 19 nt Target #3: | 5'-UAGAUGAAGUGGCAGGUAU-3' | (SEQ ID NO: 5386) |
| CKAP5-2839 19 nt Target #1: | 5'-AAUAUAGGUGAACUUCCAA-3' | (SEQ ID NO: 4235) |
| CKAP5-2839 19 nt Target #2: | 5'-GAAUAUAGGUGAACUUCCA-3' | (SEQ ID NO: 4811) |
| CKAP5-2839 19 nt Target #3: | 5'-CGAAUAUAGGUGAACUUCC-3' | (SEQ ID NO: 5387) |
| CKAP5-2841 19 nt Target #1: | 5'-UAUAGGUGAACUUCCAACU-3' | (SEQ ID NO: 4236) |
| CKAP5-2841 19 nt Target #2: | 5'-AUAUAGGUGAACUUCCAAC-3' | (SEQ ID NO: 4812) |
| CKAP5-2841 19 nt Target #3: | 5'-AAUAUAGGUGAACUUCCAA-3' | (SEQ ID NO: 5388) |
| CKAP5-2843 19 nt Target #1: | 5'-UAGGUGAACUUCCAACUGC-3' | (SEQ ID NO: 4237) |
| CKAP5-2843 19 nt Target #2: | 5'-AUAGGUGAACUUCCAACUG-3' | (SEQ ID NO: 4813) |
| CKAP5-2843 19 nt Target #3: | 5'-UAUAGGUGAACUUCCAACU-3' | (SEQ ID NO: 5389) |
| CKAP5-2845 19 nt Target #1: | 5'-GGUGAACUUCCAACUGCCU-3' | (SEQ ID NO: 4238) |
| CKAP5-2845 19 nt Target #2: | 5'-AGGUGAACUUCCAACUGCC-3' | (SEQ ID NO: 4814) |
| CKAP5-2845 19 nt Target #3: | 5'-UAGGUGAACUUCCAACUGC-3' | (SEQ ID NO: 5390) |
| CKAP5-2847 19 nt Target #1: | 5'-UGAACUUCCAACUGCCUUG-3' | (SEQ ID NO: 4239) |
| CKAP5-2847 19 nt Target #2: | 5'-GUGAACUUCCAACUGCCUU-3' | (SEQ ID NO: 4815) |
| CKAP5-2847 19 nt Target #3: | 5'-GGUGAACUUCCAACUGCCU-3' | (SEQ ID NO: 5391) |
| CKAP5-2849 19 nt Target #1: | 5'-AACUUCCAACUGCCUUGAA-3' | (SEQ ID NO: 4240) |
| CKAP5-2849 19 nt Target #2: | 5'-GAACUUCCAACUGCCUUGA-3' | (SEQ ID NO: 4816) |
| CKAP5-2849 19 nt Target #3: | 5'-UGAACUUCCAACUGCCUUG-3' | (SEQ ID NO: 5392) |
| CKAP5-2851 19 nt Target #1: | 5'-CUUCCAACUGCCUUGAAGG-3' | (SEQ ID NO: 4241) |
| CKAP5-2851 19 nt Target #2: | 5'-ACUUCCAACUGCCUUGAAG-3' | (SEQ ID NO: 4817) |
| CKAP5-2851 19 nt Target #3: | 5'-AACUUCCAACUGCCUUGAA-3' | (SEQ ID NO: 5393) |
| CKAP5-2853 19 nt Target #1: | 5'-UCCAACUGCCUUGAAGGGU-3' | (SEQ ID NO: 4242) |
| CKAP5-2853 19 nt Target #2: | 5'-UUCCAACUGCCUUGAAGGG-3' | (SEQ ID NO: 4818) |
| CKAP5-2853 19 nt Target #3: | 5'-CUUCCAACUGCCUUGAAGG-3' | (SEQ ID NO: 5394) |
| CKAP5-2855 19 nt Target #1: | 5'-CAACUGCCUUGAAGGGUCG-3' | (SEQ ID NO: 4243) |
| CKAP5-2855 19 nt Target #2: | 5'-CCAACUGCCUUGAAGGGUC-3' | (SEQ ID NO: 4819) |
| CKAP5-2855 19 nt Target #3: | 5'-UCCAACUGCCUUGAAGGGU-3' | (SEQ ID NO: 5395) |
| CKAP5-2857 19 nt Target #1: | 5'-ACUGCCUUGAAGGGUCGAC-3' | (SEQ ID NO: 4244) |
| CKAP5-2857 19 nt Target #2: | 5'-AACUGCCUUGAAGGGUCGA-3' | (SEQ ID NO: 4820) |
| CKAP5-2857 19 nt Target #3: | 5'-CAACUGCCUUGAAGGGUCG-3' | (SEQ ID NO: 5396) |
| CKAP5-2926 19 nt Target #1: | 5'-CAACUGGCAGUAGCCAUGG-3' | (SEQ ID NO: 4245) |
| CKAP5-2926 19 nt Target #2: | 5'-ACAACUGGCAGUAGCCAUG-3' | (SEQ ID NO: 4821) |
| CKAP5-2926 19 nt Target #3: | 5'-AACAACUGGCAGUAGCCAU-3' | (SEQ ID NO: 5397) |

TABLE 7-continued

DsiRNA Component 19 Nucleotide Target Sequences In CKAP5 mRNA

| | | |
|---|---|---|
| CKAP5-3007 19 nt Target #1: | 5'-AGCAAGAACAAUGUUCGAG-3' | (SEQ ID NO: 4246) |
| CKAP5-3007 19 nt Target #2: | 5'-CAGCAAGAACAAUGUUCGA-3' | (SEQ ID NO: 4822) |
| CKAP5-3007 19 nt Target #3: | 5'-ACAGCAAGAACAAUGUUCG-3' | (SEQ ID NO: 5398) |
| CKAP5-3009 19 nt Target #1: | 5'-CAAGAACAAUGUUCGAGCU-3' | (SEQ ID NO: 4247) |
| CKAP5-3009 19 nt Target #2: | 5'-GCAAGAACAAUGUUCGAGC-3' | (SEQ ID NO: 4823) |
| CKAP5-3009 19 nt Target #3: | 5'-AGCAAGAACAAUGUUCGAG-3' | (SEQ ID NO: 5399) |
| CKAP5-3011 19 nt Target #1: | 5'-AGAACAAUGUUCGAGCUGC-3' | (SEQ ID NO: 4248) |
| CKAP5-3011 19 nt Target #2: | 5'-AAGAACAAUGUUCGAGCUG-3' | (SEQ ID NO: 4824) |
| CKAP5-3011 19 nt Target #3: | 5'-CAAGAACAAUGUUCGAGCU-3' | (SEQ ID NO: 5400) |
| CKAP5-3013 19 nt Target #1: | 5'-AACAAUGUUCGAGCUGCUG-3' | (SEQ ID NO: 4249) |
| CKAP5-3013 19 nt Target #2: | 5'-GAACAAUGUUCGAGCUGCU-3' | (SEQ ID NO: 4825) |
| CKAP5-3013 19 nt Target #3: | 5'-AGAACAAUGUUCGAGCUGC-3' | (SEQ ID NO: 5401) |
| CKAP5-3015 19 nt Target #1: | 5'-CAAUGUUCGAGCUGCUGCC-3' | (SEQ ID NO: 4250) |
| CKAP5-3015 19 nt Target #2: | 5'-ACAAUGUUCGAGCUGCUGC-3' | (SEQ ID NO: 4826) |
| CKAP5-3015 19 nt Target #3: | 5'-AACAAUGUUCGAGCUGCUG-3' | (SEQ ID NO: 5402) |
| CKAP5-3017 19 nt Target #1: | 5'-AUGUUCGAGCUGCUGCCCU-3' | (SEQ ID NO: 4251) |
| CKAP5-3017 19 nt Target #2: | 5'-AAUGUUCGAGCUGCUGCCC-3' | (SEQ ID NO: 4827) |
| CKAP5-3017 19 nt Target #3: | 5'-CAAUGUUCGAGCUGCUGCC-3' | (SEQ ID NO: 5403) |
| CKAP5-3019 19 nt Target #1: | 5'-GUUCGAGCUGCUGCCCUAG-3' | (SEQ ID NO: 4252) |
| CKAP5-3019 19 nt Target #2: | 5'-UGUUCGAGCUGCUGCCCUA-3' | (SEQ ID NO: 4828) |
| CKAP5-3019 19 nt Target #3: | 5'-AUGUUCGAGCUGCUGCCCU-3' | (SEQ ID NO: 5404) |
| CKAP5-3040 19 nt Target #1: | 5'-ACUGUGAAUGCUUGGGCAG-3' | (SEQ ID NO: 4253) |
| CKAP5-3040 19 nt Target #2: | 5'-GACUGUGAAUGCUUGGGCA-3' | (SEQ ID NO: 4829) |
| CKAP5-3040 19 nt Target #3: | 5'-CGACUGUGAAUGCUUGGGC-3' | (SEQ ID NO: 5405) |
| CKAP5-3042 19 nt Target #1: | 5'-UGUGAAUGCUUGGGCAGAA-3' | (SEQ ID NO: 4254) |
| CKAP5-3042 19 nt Target #2: | 5'-CUGUGAAUGCUUGGGCAGA-3' | (SEQ ID NO: 4830) |
| CKAP5-3042 19 nt Target #3: | 5'-ACUGUGAAUGCUUGGGCAG-3' | (SEQ ID NO: 5406) |
| CKAP5-3044 19 nt Target #1: | 5'-UGAAUGCUUGGGCAGAACA-3' | (SEQ ID NO: 4255) |
| CKAP5-3044 19 nt Target #2: | 5'-GUGAAUGCUUGGGCAGAAC-3' | (SEQ ID NO: 4831) |
| CKAP5-3044 19 nt Target #3: | 5'-UGUGAAUGCUUGGGCAGAA-3' | (SEQ ID NO: 5407) |
| CKAP5-3089 19 nt Target #1: | 5'-GAGAAGAUCUUUCUGAAGA-3' | (SEQ ID NO: 4256) |
| CKAP5-3089 19 nt Target #2: | 5'-GGAGAAGAUCUUUCUGAAG-3' | (SEQ ID NO: 4832) |
| CKAP5-3089 19 nt Target #3: | 5'-AGGAGAAGAUCUUUCUGAA-3' | (SEQ ID NO: 5408) |
| CKAP5-3229 19 nt Target #1: | 5'-CUAGAAGAUCGAAAUGGAG-3' | (SEQ ID NO: 4257) |
| CKAP5-3229 19 nt Target #2: | 5'-CCUAGAAGAUCGAAAUGGA-3' | (SEQ ID NO: 4833) |
| CKAP5-3229 19 nt Target #3: | 5'-GCCUAGAAGAUCGAAAUGG-3' | (SEQ ID NO: 5409) |
| CKAP5-3231 19 nt Target #1: | 5'-AGAAGAUCGAAAUGGAGAU-3' | (SEQ ID NO: 4258) |
| CKAP5-3231 19 nt Target #2: | 5'-UAGAAGAUCGAAAUGGAGA-3' | (SEQ ID NO: 4834) |
| CKAP5-3231 19 nt Target #3: | 5'-CUAGAAGAUCGAAAUGGAG-3' | (SEQ ID NO: 5410) |

TABLE 7-continued

DsiRNA Component 19 Nucleotide Target Sequences In CKAP5 mRNA

| | | |
|---|---|---|
| CKAP5-3233 19 nt Target #1: | 5'-AAGAUCGAAAUGGAGAUGU-3' | (SEQ ID NO: 4259) |
| CKAP5-3233 19 nt Target #2: | 5'-GAAGAUCGAAAUGGAGAUG-3' | (SEQ ID NO: 4835) |
| CKAP5-3233 19 nt Target #3: | 5'-AGAAGAUCGAAAUGGAGAU-3' | (SEQ ID NO: 5411) |
| CKAP5-3287 19 nt Target #1: | 5'-UGAUGCAUUUAGGAUAUGA-3' | (SEQ ID NO: 4260) |
| CKAP5-3287 19 nt Target #2: | 5'-AUGAUGCAUUUAGGAUAUG-3' | (SEQ ID NO: 4836) |
| CKAP5-3287 19 nt Target #3: | 5'-CAUGAUGCAUUUAGGAUAU-3' | (SEQ ID NO: 5412) |
| CKAP5-3289 19 nt Target #1: | 5'-AUGCAUUUAGGAUAUGAAA-3' | (SEQ ID NO: 4261) |
| CKAP5-3289 19 nt Target #2: | 5'-GAUGCAUUUAGGAUAUGAA-3' | (SEQ ID NO: 4837) |
| CKAP5-3289 19 nt Target #3: | 5'-UGAUGCAUUUAGGAUAUGA-3' | (SEQ ID NO: 5413) |
| CKAP5-3291 19 nt Target #1: | 5'-GCAUUUAGGAUAUGAAAAA-3' | (SEQ ID NO: 4262) |
| CKAP5-3291 19 nt Target #2: | 5'-UGCAUUUAGGAUAUGAAAA-3' | (SEQ ID NO: 4838) |
| CKAP5-3291 19 nt Target #3: | 5'-AUGCAUUUAGGAUAUGAAA-3' | (SEQ ID NO: 5414) |
| CKAP5-3293 19 nt Target #1: | 5'-AUUUAGGAUAUGAAAAAAU-3' | (SEQ ID NO: 4263) |
| CKAP5-3293 19 nt Target #2: | 5'-CAUUUAGGAUAUGAAAAAA-3' | (SEQ ID NO: 4839) |
| CKAP5-3293 19 nt Target #3: | 5'-GCAUUUAGGAUAUGAAAAA-3' | (SEQ ID NO: 5415) |
| CKAP5-3295 19 nt Target #1: | 5'-UUAGGAUAUGAAAAAUGG-3' | (SEQ ID NO: 4264) |
| CKAP5-3295 19 nt Target #2: | 5'-UUUAGGAUAUGAAAAAAUG-3' | (SEQ ID NO: 4840) |
| CKAP5-3295 19 nt Target #3: | 5'-AUUUAGGAUAUGAAAAAAU-3' | (SEQ ID NO: 5416) |
| CKAP5-3316 19 nt Target #1: | 5'-AAGGCUACUGGGAAACUAA-3' | (SEQ ID NO: 4265) |
| CKAP5-3316 19 nt Target #2: | 5'-CAAGGCUACUGGGAAACUA-3' | (SEQ ID NO: 4841) |
| CKAP5-3316 19 nt Target #3: | 5'-CCAAGGCUACUGGGAAACU-3' | (SEQ ID NO: 5417) |
| CKAP5-3318 19 nt Target #1: | 5'-GGCUACUGGGAAACUAAAG-3' | (SEQ ID NO: 4266) |
| CKAP5-3318 19 nt Target #2: | 5'-AGGCUACUGGGAAACUAAA-3' | (SEQ ID NO: 4842) |
| CKAP5-3318 19 nt Target #3: | 5'-AAGGCUACUGGGAAACUAA-3' | (SEQ ID NO: 5418) |
| CKAP5-3320 19 nt Target #1: | 5'-CUACUGGGAAACUAAAGCC-3' | (SEQ ID NO: 4267) |
| CKAP5-3320 19 nt Target #2: | 5'-GCUACUGGGAAACUAAAGC-3' | (SEQ ID NO: 4843) |
| CKAP5-3320 19 nt Target #3: | 5'-GGCUACUGGGAAACUAAAG-3' | (SEQ ID NO: 5419) |
| CKAP5-3322 19 nt Target #1: | 5'-ACUGGGAAACUAAAGCCAA-3' | (SEQ ID NO: 4268) |
| CKAP5-3322 19 nt Target #2: | 5'-UACUGGGAAACUAAAGCCA-3' | (SEQ ID NO: 4844) |
| CKAP5-3322 19 nt Target #3: | 5'-CUACUGGGAAACUAAAGCC-3' | (SEQ ID NO: 5420) |
| CKAP5-3324 19 nt Target #1: | 5'-UGGGAAACUAAAGCCAACU-3' | (SEQ ID NO: 4269) |
| CKAP5-3324 19 nt Target #2: | 5'-CUGGGAAACUAAAGCCAAC-3' | (SEQ ID NO: 4845) |
| CKAP5-3324 19 nt Target #3: | 5'-ACUGGGAAACUAAAGCCAA-3' | (SEQ ID NO: 5421) |
| CKAP5-3326 19 nt Target #1: | 5'-GGAAACUAAAGCCAACUUC-3' | (SEQ ID NO: 4270) |
| CKAP5-3326 19 nt Target #2: | 5'-GGGAAACUAAAGCCAACUU-3' | (SEQ ID NO: 4846) |
| CKAP5-3326 19 nt Target #3: | 5'-UGGGAAACUAAAGCCAACU-3' | (SEQ ID NO: 5422) |
| CKAP5-3328 19 nt Target #1: | 5'-AAACUAAAGCCAACUUCUA-3' | (SEQ ID NO: 4271) |
| CKAP5-3328 19 nt Target #2: | 5'-GAAACUAAAGCCAACUUCU-3' | (SEQ ID NO: 4847) |
| CKAP5-3328 19 nt Target #3: | 5'-GGAAACUAAAGCCAACUUC-3' | (SEQ ID NO: 5423) |

TABLE 7-continued

DsiRNA Component 19 Nucleotide Target Sequences In CKAP5 mRNA

| | | |
|---|---|---|
| CKAP5-3330 19 nt Target #1: | 5'-ACUAAAGCCAACUUCUAAA-3' | (SEQ ID NO: 4272) |
| CKAP5-3330 19 nt Target #2: | 5'-AACUAAAGCCAACUUCUAA-3' | (SEQ ID NO: 4848) |
| CKAP5-3330 19 nt Target #3: | 5'-AAACUAAAGCCAACUUCUA-3' | (SEQ ID NO: 5424) |
| CKAP5-3332 19 nt Target #1: | 5'-UAAAGCCAACUUCUAAAGA-3' | (SEQ ID NO: 4273) |
| CKAP5-3332 19 nt Target #2: | 5'-CUAAAGCCAACUUCUAAAG-3' | (SEQ ID NO: 4849) |
| CKAP5-3332 19 nt Target #3: | 5'-ACUAAAGCCAACUUCUAAA-3' | (SEQ ID NO: 5425) |
| CKAP5-3334 19 nt Target #1: | 5'-AAGCCAACUUCUAAAGAUC-3' | (SEQ ID NO: 4274) |
| CKAP5-3334 19 nt Target #2: | 5'-AAAGCCAACUUCUAAAGAU-3' | (SEQ ID NO: 4850) |
| CKAP5-3334 19 nt Target #3: | 5'-UAAAGCCAACUUCUAAAGA-3' | (SEQ ID NO: 5426) |
| CKAP5-3625 19 nt Target #1: | 5'-CCUAUUUUAUUGUUGUUC-3' | (SEQ ID NO: 4275) |
| CKAP5-3625 19 nt Target #2: | 5'-GCCUAUUUUAUUGUUGUU-3' | (SEQ ID NO: 4851) |
| CKAP5-3625 19 nt Target #3: | 5'-GGCCUAUUUUAUUGUUGU-3' | (SEQ ID NO: 5427) |
| CKAP5-3627 19 nt Target #1: | 5'-UAUUUUAUUGUUGUUCCA-3' | (SEQ ID NO: 4276) |
| CKAP5-3627 19 nt Target #2: | 5'-CUAUUUUAUUGUUGUUCC-3' | (SEQ ID NO: 4852) |
| CKAP5-3627 19 nt Target #3: | 5'-CCUAUUUUAUUGUUGUUC-3' | (SEQ ID NO: 5428) |
| CKAP5-3629 19 nt Target #1: | 5'-UUUUAUUGUUGUUCCAAA-3' | (SEQ ID NO: 4277) |
| CKAP5-3629 19 nt Target #2: | 5'-AUUUUAUUGUUGUUCCAA-3' | (SEQ ID NO: 4853) |
| CKAP5-3629 19 nt Target #3: | 5'-UAUUUUAUUGUUGUUCCA-3' | (SEQ ID NO: 5429) |
| CKAP5-3631 19 nt Target #1: | 5'-UUUAUUGUUGUUCCAAAUG-3' | (SEQ ID NO: 4278) |
| CKAP5-3631 19 nt Target #2: | 5'-UUUUAUUGUUGUUCCAAAU-3' | (SEQ ID NO: 4854) |
| CKAP5-3631 19 nt Target #3: | 5'-UUUUUAUUGUUGUUCCAAA-3' | (SEQ ID NO: 5430) |
| CKAP5-3633 19 nt Target #1: | 5'-UAUUGUUGUUCCAAAUGGA-3' | (SEQ ID NO: 4279) |
| CKAP5-3633 19 nt Target #2: | 5'-UUAUUGUUGUUCCAAAUGG-3' | (SEQ ID NO: 4855) |
| CKAP5-3633 19 nt Target #3: | 5'-UUUAUUGUUGUUCCAAAUG-3' | (SEQ ID NO: 5431) |
| CKAP5-3635 19 nt Target #1: | 5'-UUGUUGUUCCAAAUGGAAA-3' | (SEQ ID NO: 4280) |
| CKAP5-3635 19 nt Target #2: | 5'-AUUGUUGUUCCAAAUGGAA-3' | (SEQ ID NO: 4856) |
| CKAP5-3635 19 nt Target #3: | 5'-UAUUGUUGUUCCAAAUGGA-3' | (SEQ ID NO: 5432) |
| CKAP5-3686 19 nt Target #1: | 5'-AGGUGCUAAAGUGGAAUUU-3' | (SEQ ID NO: 4281) |
| CKAP5-3686 19 nt Target #2: | 5'-AAGGUGCUAAAGUGGAAUU-3' | (SEQ ID NO: 4857) |
| CKAP5-3686 19 nt Target #3: | 5'-GAAGGUGCUAAAGUGGAAU-3' | (SEQ ID NO: 5433) |
| CKAP5-3688 19 nt Target #1: | 5'-GUGCUAAAGUGGAAUUUA-3' | (SEQ ID NO: 4282) |
| CKAP5-3688 19 nt Target #2: | 5'-GGUGCUAAAGUGGAAUUUU-3' | (SEQ ID NO: 4858) |
| CKAP5-3688 19 nt Target #3: | 5'-AGGUGCUAAAGUGGAAUUU-3' | (SEQ ID NO: 5434) |
| CKAP5-3989 19 nt Target #1: | 5'-AUCAUCUUACUGAGAAUGA-3' | (SEQ ID NO: 4283) |
| CKAP5-3989 19 nt Target #2: | 5'-UAUCAUCUUACUGAGAAUG-3' | (SEQ ID NO: 4859) |
| CKAP5-3989 19 nt Target #3: | 5'-AUAUCAUCUUACUGAGAAU-3' | (SEQ ID NO: 5435) |
| CKAP5-3991 19 nt Target #1: | 5'-CAUCUUACUGAGAAUGAAG-3' | (SEQ ID NO: 4284) |
| CKAP5-3991 19 nt Target #2: | 5'-UCAUCUUACUGAGAAUGAA-3' | (SEQ ID NO: 4860) |
| CKAP5-3991 19 nt Target #3: | 5'-AUCAUCUUACUGAGAAUGA-3' | (SEQ ID NO: 5436) |

TABLE 7-continued

DsiRNA Component 19 Nucleotide Target Sequences In CKAP5 mRNA

| | | |
|---|---|---|
| CKAP5-3993 19 nt Target #1: | 5'-UCUUACUGAGAAUGAAGCA-3' | (SEQ ID NO: 4285) |
| CKAP5-3993 19 nt Target #2: | 5'-AUCUUACUGAGAAUGAAGC-3' | (SEQ ID NO: 4861) |
| CKAP5-3993 19 nt Target #3: | 5'-CAUCUUACUGAGAAUGAAG-3' | (SEQ ID NO: 5437) |
| CKAP5-3995 19 nt Target #1: | 5'-UUACUGAGAAUGAAGCAUC-3' | (SEQ ID NO: 4286) |
| CKAP5-3995 19 nt Target #2: | 5'-CUUACUGAGAAUGAAGCAU-3' | (SEQ ID NO: 4862) |
| CKAP5-3995 19 nt Target #3: | 5'-UCUUACUGAGAAUGAAGCA-3' | (SEQ ID NO: 5438) |
| CKAP5-4038 19 nt Target #1: | 5'-CAAGGUUGGAGAACCAAAG-3' | (SEQ ID NO: 4287) |
| CKAP5-4038 19 nt Target #2: | 5'-UCAAGGUUGGAGAACCAAA-3' | (SEQ ID NO: 4863) |
| CKAP5-4038 19 nt Target #3: | 5'-GUCAAGGUUGGAGAACCAA-3' | (SEQ ID NO: 5439) |
| CKAP5-4040 19 nt Target #1: | 5'-AGGUUGGAGAACCAAAGGA-3' | (SEQ ID NO: 4288) |
| CKAP5-4040 19 nt Target #2: | 5'-AAGGUUGGAGAACCAAAGG-3' | (SEQ ID NO: 4864) |
| CKAP5-4040 19 nt Target #3: | 5'-CAAGGUUGGAGAACCAAAG-3' | (SEQ ID NO: 5440) |
| CKAP5-4042 19 nt Target #1: | 5'-GUUGGAGAACCAAAGGAUG-3' | (SEQ ID NO: 4289) |
| CKAP5-4042 19 nt Target #2: | 5'-GGUUGGAGAACCAAAGGAU-3' | (SEQ ID NO: 4865) |
| CKAP5-4042 19 nt Target #3: | 5'-AGGUUGGAGAACCAAAGGA-3' | (SEQ ID NO: 5441) |
| CKAP5-4044 19 nt Target #1: | 5'-UGGAGAACCAAAGGAUGUC-3' | (SEQ ID NO: 4290) |
| CKAP5-4044 19 nt Target #2: | 5'-UUGGAGAACCAAAGGAUGU-3' | (SEQ ID NO: 4866) |
| CKAP5-4044 19 nt Target #3: | 5'-GUUGGAGAACCAAAGGAUG-3' | (SEQ ID NO: 5442) |
| CKAP5-4046 19 nt Target #1: | 5'-GAGAACCAAAGGAUGUCAU-3' | (SEQ ID NO: 4291) |
| CKAP5-4046 19 nt Target #2: | 5'-GGAGAACCAAAGGAUGUCA-3' | (SEQ ID NO: 4867) |
| CKAP5-4046 19 nt Target #3: | 5'-UGGAGAACCAAAGGAUGUC-3' | (SEQ ID NO: 5443) |
| CKAP5-4048 19 nt Target #1: | 5'-GAACCAAAGGAUGUCAUUC-3' | (SEQ ID NO: 4292) |
| CKAP5-4048 19 nt Target #2: | 5'-AGAACCAAAGGAUGUCAUU-3' | (SEQ ID NO: 4868) |
| CKAP5-4048 19 nt Target #3: | 5'-GAGAACCAAAGGAUGUCAU-3' | (SEQ ID NO: 5444) |
| CKAP5-4050 19 nt Target #1: | 5'-ACCAAAGGAUGUCAUUCGU-3' | (SEQ ID NO: 4293) |
| CKAP5-4050 19 nt Target #2: | 5'-AACCAAAGGAUGUCAUUCG-3' | (SEQ ID NO: 4869) |
| CKAP5-4050 19 nt Target #3: | 5'-GAACCAAAGGAUGUCAUUC-3' | (SEQ ID NO: 5445) |
| CKAP5-4052 19 nt Target #1: | 5'-CAAAGGAUGUCAUUCGUAA-3' | (SEQ ID NO: 4294) |
| CKAP5-4052 19 nt Target #2: | 5'-CCAAAGGAUGUCAUUCGUA-3' | (SEQ ID NO: 4870) |
| CKAP5-4052 19 nt Target #3: | 5'-ACCAAAGGAUGUCAUUCGU-3' | (SEQ ID NO: 5446) |
| CKAP5-4054 19 nt Target #1: | 5'-AAGGAUGUCAUUCGUAAAG-3' | (SEQ ID NO: 4295) |
| CKAP5-4054 19 nt Target #2: | 5'-AAAGGAUGUCAUUCGUAAA-3' | (SEQ ID NO: 4871) |
| CKAP5-4054 19 nt Target #3: | 5'-CAAAGGAUGUCAUUCGUAA-3' | (SEQ ID NO: 5447) |
| CKAP5-4056 19 nt Target #1: | 5'-GGAUGUCAUUCGUAAAGAU-3' | (SEQ ID NO: 4296) |
| CKAP5-4056 19 nt Target #2: | 5'-AGGAUGUCAUUCGUAAAGA-3' | (SEQ ID NO: 4872) |
| CKAP5-4056 19 nt Target #3: | 5'-AAGGAUGUCAUUCGUAAAG-3' | (SEQ ID NO: 5448) |
| CKAP5-4058 19 nt Target #1: | 5'-AUGUCAUUCGUAAAGAUGU-3' | (SEQ ID NO: 4297) |
| CKAP5-4058 19 nt Target #2: | 5'-GAUGUCAUUCGUAAAGAUG-3' | (SEQ ID NO: 4873) |
| CKAP5-4058 19 nt Target #3: | 5'-GGAUGUCAUUCGUAAAGAU-3' | (SEQ ID NO: 5449) |

TABLE 7-continued

DsiRNA Component 19 Nucleotide Target Sequences In CKAP5 mRNA

| | | |
|---|---|---|
| CKAP5-4085 19 nt Target #1: | 5'-UCCUGAACCGGAUGUGCCU-3' | (SEQ ID NO: 4298) |
| CKAP5-4085 19 nt Target #2: | 5'-AUCCUGAACCGGAUGUGCC-3' | (SEQ ID NO: 4874) |
| CKAP5-4085 19 nt Target #3: | 5'-CAUCCUGAACCGGAUGUGC-3' | (SEQ ID NO: 5450) |
| CKAP5-4087 19 nt Target #1: | 5'-CUGAACCGGAUGUGCCUUG-3' | (SEQ ID NO: 4299) |
| CKAP5-4087 19 nt Target #2: | 5'-CCUGAACCGGAUGUGCCUU-3' | (SEQ ID NO: 4875) |
| CKAP5-4087 19 nt Target #3: | 5'-UCCUGAACCGGAUGUGCCU-3' | (SEQ ID NO: 5451) |
| CKAP5-4089 19 nt Target #1: | 5'-GAACCGGAUGUGCCUUGUC-3' | (SEQ ID NO: 4300) |
| CKAP5-4089 19 nt Target #2: | 5'-UGAACCGGAUGUGCCUUGU-3' | (SEQ ID NO: 4876) |
| CKAP5-4089 19 nt Target #3: | 5'-CUGAACCGGAUGUGCCUUG-3' | (SEQ ID NO: 5452) |
| CKAP5-4091 19 nt Target #1: | 5'-ACCGGAUGUGCCUUGUCUA-3' | (SEQ ID NO: 4301) |
| CKAP5-4091 19 nt Target #2: | 5'-AACCGGAUGUGCCUUGUCU-3' | (SEQ ID NO: 4877) |
| CKAP5-4091 19 nt Target #3: | 5'-GAACCGGAUGUGCCUUGUC-3' | (SEQ ID NO: 5453) |
| CKAP5-4093 19 nt Target #1: | 5'-CGGAUGUGCCUUGUCUACC-3' | (SEQ ID NO: 4302) |
| CKAP5-4093 19 nt Target #2: | 5'-CCGGAUGUGCCUUGUCUAC-3' | (SEQ ID NO: 4878) |
| CKAP5-4093 19 nt Target #3: | 5'-ACCGGAUGUGCCUUGUCUA-3' | (SEQ ID NO: 5454) |
| CKAP5-4095 19 nt Target #1: | 5'-GAUGUGCCUUGUCUACCCA-3' | (SEQ ID NO: 4303) |
| CKAP5-4095 19 nt Target #2: | 5'-GGAUGUGCCUUGUCUACCC-3' | (SEQ ID NO: 4879) |
| CKAP5-4095 19 nt Target #3: | 5'-CGGAUGUGCCUUGUCUACC-3' | (SEQ ID NO: 5455) |
| CKAP5-4097 19 nt Target #1: | 5'-UGUGCCUUGUCUACCCAGC-3' | (SEQ ID NO: 4304) |
| CKAP5-4097 19 nt Target #2: | 5'-AUGUGCCUUGUCUACCCAG-3' | (SEQ ID NO: 4880) |
| CKAP5-4097 19 nt Target #3: | 5'-GAUGUGCCUUGUCUACCCA-3' | (SEQ ID NO: 5456) |
| CKAP5-4154 19 nt Target #1: | 5'-CCAAAAACUCUAAGCAGAG-3' | (SEQ ID NO: 4305) |
| CKAP5-4154 19 nt Target #2: | 5'-UCCAAAAACUCUAAGCAGA-3' | (SEQ ID NO: 4881) |
| CKAP5-4154 19 nt Target #3: | 5'-AUCCAAAAACUCUAAGCAG-3' | (SEQ ID NO: 5457) |
| CKAP5-4156 19 nt Target #1: | 5'-AAAAACUCUAAGCAGAGAG-3' | (SEQ ID NO: 4306) |
| CKAP5-4156 19 nt Target #2: | 5'-CAAAAACUCUAAGCAGAGA-3' | (SEQ ID NO: 4882) |
| CKAP5-4156 19 nt Target #3: | 5'-CCAAAAACUCUAAGCAGAG-3' | (SEQ ID NO: 5458) |
| CKAP5-4158 19 nt Target #1: | 5'-AAACUCUAAGCAGAGAGCA-3' | (SEQ ID NO: 4307) |
| CKAP5-4158 19 nt Target #2: | 5'-AAAACUCUAAGCAGAGAGC-3' | (SEQ ID NO: 4883) |
| CKAP5-4158 19 nt Target #3: | 5'-AAAAACUCUAAGCAGAGAG-3' | (SEQ ID NO: 5459) |
| CKAP5-4160 19 nt Target #1: | 5'-ACUCUAAGCAGAGAGCAGA-3' | (SEQ ID NO: 4308) |
| CKAP5-4160 19 nt Target #2: | 5'-AACUCUAAGCAGAGAGCAG-3' | (SEQ ID NO: 4884) |
| CKAP5-4160 19 nt Target #3: | 5'-AAACUCUAAGCAGAGAGCA-3' | (SEQ ID NO: 5460) |
| CKAP5-4162 19 nt Target #1: | 5'-UCUAAGCAGAGAGCAGAGU-3' | (SEQ ID NO: 4309) |
| CKAP5-4162 19 nt Target #2: | 5'-CUCUAAGCAGAGAGCAGAG-3' | (SEQ ID NO: 4885) |
| CKAP5-4162 19 nt Target #3: | 5'-ACUCUAAGCAGAGAGCAGA-3' | (SEQ ID NO: 5461) |
| CKAP5-4164 19 nt Target #1: | 5'-UAAGCAGAGAGCAGAGUGC-3' | (SEQ ID NO: 4310) |
| CKAP5-4164 19 nt Target #2: | 5'-CUAAGCAGAGAGCAGAGUG-3' | (SEQ ID NO: 4886) |
| CKAP5-4164 19 nt Target #3: | 5'-UCUAAGCAGAGAGCAGAGU-3' | (SEQ ID NO: 5462) |

TABLE 7-continued

DsiRNA Component 19 Nucleotide Target Sequences In CKAP5 mRNA

| | | |
|---|---|---|
| CKAP5-4166 19 nt Target #1: | 5'-AGCAGAGAGCAGAGUGCCU-3' | (SEQ ID NO: 4311) |
| CKAP5-4166 19 nt Target #2: | 5'-AAGCAGAGAGCAGAGUGCC-3' | (SEQ ID NO: 4887) |
| CKAP5-4166 19 nt Target #3: | 5'-UAAGCAGAGAGCAGAGUGC-3' | (SEQ ID NO: 5463) |
| CKAP5-4168 19 nt Target #1: | 5'-CAGAGAGCAGAGUGCCUGG-3' | (SEQ ID NO: 4312) |
| CKAP5-4168 19 nt Target #2: | 5'-GCAGAGAGCAGAGUGCCUG-3' | (SEQ ID NO: 4888) |
| CKAP5-4168 19 nt Target #3: | 5'-AGCAGAGAGCAGAGUGCCU-3' | (SEQ ID NO: 5464) |
| CKAP5-4170 19 nt Target #1: | 5'-GAGAGCAGAGUGCCUGGAA-3' | (SEQ ID NO: 4313) |
| CKAP5-4170 19 nt Target #2: | 5'-AGAGAGCAGAGUGCCUGGA-3' | (SEQ ID NO: 4889) |
| CKAP5-4170 19 nt Target #3: | 5'-CAGAGAGCAGAGUGCCUGG-3' | (SEQ ID NO: 5465) |
| CKAP5-4172 19 nt Target #1: | 5'-GAGCAGAGUGCCUGGAAGA-3' | (SEQ ID NO: 4314) |
| CKAP5-4172 19 nt Target #2: | 5'-AGAGCAGAGUGCCUGGAAG-3' | (SEQ ID NO: 4890) |
| CKAP5-4172 19 nt Target #3: | 5'-GAGAGCAGAGUGCCUGGAA-3' | (SEQ ID NO: 5466) |
| CKAP5-4174 19 nt Target #1: | 5'-GCAGAGUGCCUGGAAGAGC-3' | (SEQ ID NO: 4315) |
| CKAP5-4174 19 nt Target #2: | 5'-AGCAGAGUGCCUGGAAGAG-3' | (SEQ ID NO: 4891) |
| CKAP5-4174 19 nt Target #3: | 5'-GAGCAGAGUGCCUGGAAGA-3' | (SEQ ID NO: 5467) |
| CKAP5-4241 19 nt Target #1: | 5'-CAGGAAAAGCCUUAAAGGA-3' | (SEQ ID NO: 4316) |
| CKAP5-4241 19 nt Target #2: | 5'-CCAGGAAAAGCCUUAAAGG-3' | (SEQ ID NO: 4892) |
| CKAP5-4241 19 nt Target #3: | 5'-CCCAGGAAAAGCCUUAAAG-3' | (SEQ ID NO: 5468) |
| CKAP5-4346 19 nt Target #1: | 5'-AUCAGGUGUUCAAACUGAU-3' | (SEQ ID NO: 4317) |
| CKAP5-4346 19 nt Target #2: | 5'-GAUCAGGUGUUCAAACUGA-3' | (SEQ ID NO: 4893) |
| CKAP5-4346 19 nt Target #3: | 5'-GGAUCAGGUGUUCAAACUG-3' | (SEQ ID NO: 5469) |
| CKAP5-4348 19 nt Target #1: | 5'-CAGGUGUUCAAACUGAUUG-3' | (SEQ ID NO: 4318) |
| CKAP5-4348 19 nt Target #2: | 5'-UCAGGUGUUCAAACUGAUU-3' | (SEQ ID NO: 4894) |
| CKAP5-4348 19 nt Target #3: | 5'-AUCAGGUGUUCAAACUGAU-3' | (SEQ ID NO: 5470) |
| CKAP5-4350 19 nt Target #1: | 5'-GGUGUUCAAACUGAUUGGA-3' | (SEQ ID NO: 4319) |
| CKAP5-4350 19 nt Target #2: | 5'-AGGUGUUCAAACUGAUUGG-3' | (SEQ ID NO: 4895) |
| CKAP5-4350 19 nt Target #3: | 5'-CAGGUGUUCAAACUGAUUG-3' | (SEQ ID NO: 5471) |
| CKAP5-4352 19 nt Target #1: | 5'-UGUUCAAACUGAUUGGAAA-3' | (SEQ ID NO: 4320) |
| CKAP5-4352 19 nt Target #2: | 5'-GUGUUCAAACUGAUUGGAA-3' | (SEQ ID NO: 4896) |
| CKAP5-4352 19 nt Target #3: | 5'-GGUGUUCAAACUGAUUGGA-3' | (SEQ ID NO: 5472) |
| CKAP5-4354 19 nt Target #1: | 5'-UUCAAACUGAUUGGAAAUC-3' | (SEQ ID NO: 4321) |
| CKAP5-4354 19 nt Target #2: | 5'-GUUCAAACUGAUUGGAAAU-3' | (SEQ ID NO: 4897) |
| CKAP5-4354 19 nt Target #3: | 5'-UGUUCAAACUGAUUGGAAA-3' | (SEQ ID NO: 5473) |
| CKAP5-4356 19 nt Target #1: | 5'-CAAACUGAUUGGAAAUCUU-3' | (SEQ ID NO: 4322) |
| CKAP5-4356 19 nt Target #2: | 5'-UCAAACUGAUUGGAAAUCU-3' | (SEQ ID NO: 4898) |
| CKAP5-4356 19 nt Target #3: | 5'-UUCAAACUGAUUGGAAAUC-3' | (SEQ ID NO: 5474) |
| CKAP5-4358 19 nt Target #1: | 5'-AACUGAUUGGAAAUCUUUC-3' | (SEQ ID NO: 4323) |
| CKAP5-4358 19 nt Target #2: | 5'-AAACUGAUUGGAAAUCUUU-3' | (SEQ ID NO: 4899) |
| CKAP5-4358 19 nt Target #3: | 5'-CAAACUGAUUGGAAAUCUU-3' | (SEQ ID NO: 5475) |

TABLE 7-continued

DsiRNA Component 19 Nucleotide Target Sequences In CKAP5 mRNA

| | | |
|---|---|---|
| CKAP5-4360 19 nt Target #1: | 5'-CUGAUUGGAAAUCUUUCUG-3' | (SEQ ID NO: 4324) |
| CKAP5-4360 19 nt Target #2: | 5'-ACUGAUUGGAAAUCUUUCU-3' | (SEQ ID NO: 4900) |
| CKAP5-4360 19 nt Target #3: | 5'-AACUGAUUGGAAAUCUUUC-3' | (SEQ ID NO: 5476) |
| CKAP5-4411 19 nt Target #1: | 5'-AAGCGGUCAGCAAAGAGAC-3' | (SEQ ID NO: 4325) |
| CKAP5-4411 19 nt Target #2: | 5'-UAAGCGGUCAGCAAAGAGA-3' | (SEQ ID NO: 4901) |
| CKAP5-4411 19 nt Target #3: | 5'-UUAAGCGGUCAGCAAAGAG-3' | (SEQ ID NO: 5477) |
| CKAP5-4413 19 nt Target #1: | 5'-GCGGUCAGCAAAGAGACCC-3' | (SEQ ID NO: 4326) |
| CKAP5-4413 19 nt Target #2: | 5'-AGCGGUCAGCAAAGAGACC-3' | (SEQ ID NO: 4902) |
| CKAP5-4413 19 nt Target #3: | 5'-AAGCGGUCAGCAAAGAGAC-3' | (SEQ ID NO: 5478) |
| CKAP5-4415 19 nt Target #1: | 5'-GGUCAGCAAAGAGACCCUC-3' | (SEQ ID NO: 4327) |
| CKAP5-4415 19 nt Target #2: | 5'-CGGUCAGCAAAGAGACCCU-3' | (SEQ ID NO: 4903) |
| CKAP5-4415 19 nt Target #3: | 5'-GCGGUCAGCAAAGAGACCC-3' | (SEQ ID NO: 5479) |
| CKAP5-4417 19 nt Target #1: | 5'-UCAGCAAAGAGACCCUCUG-3' | (SEQ ID NO: 4328) |
| CKAP5-4417 19 nt Target #2: | 5'-GUCAGCAAAGAGACCCUCU-3' | (SEQ ID NO: 4904) |
| CKAP5-4417 19 nt Target #3: | 5'-GGUCAGCAAAGAGACCCUC-3' | (SEQ ID NO: 5480) |
| CKAP5-4419 19 nt Target #1: | 5'-AGCAAAGAGACCCUCUGCU-3' | (SEQ ID NO: 4329) |
| CKAP5-4419 19 nt Target #2: | 5'-CAGCAAAGAGACCCUCUGC-3' | (SEQ ID NO: 4905) |
| CKAP5-4419 19 nt Target #3: | 5'-UCAGCAAAGAGACCCUCUG-3' | (SEQ ID NO: 5481) |
| CKAP5-4421 19 nt Target #1: | 5'-CAAAGAGACCCUCUGCUGC-3' | (SEQ ID NO: 4330) |
| CKAP5-4421 19 nt Target #2: | 5'-GCAAAGAGACCCUCUGCUG-3' | (SEQ ID NO: 4906) |
| CKAP5-4421 19 nt Target #3: | 5'-AGCAAAGAGACCCUCUGCU-3' | (SEQ ID NO: 5482) |
| CKAP5-4423 19 nt Target #1: | 5'-AAGAGACCCUCUGCUGCAC-3' | (SEQ ID NO: 4331) |
| CKAP5-4423 19 nt Target #2: | 5'-AAAGAGACCCUCUGCUGCA-3' | (SEQ ID NO: 4907) |
| CKAP5-4423 19 nt Target #3: | 5'-CAAAGAGACCCUCUGCUGC-3' | (SEQ ID NO: 5483) |
| CKAP5-4505 19 nt Target #1: | 5'-UACGCAAGGGACCAGCUGA-3' | (SEQ ID NO: 4332) |
| CKAP5-4505 19 nt Target #2: | 5'-UUACGCAAGGGACCAGCUG-3' | (SEQ ID NO: 4908) |
| CKAP5-4505 19 nt Target #3: | 5'-GUUACGCAAGGGACCAGCU-3' | (SEQ ID NO: 5484) |
| CKAP5-4507 19 nt Target #1: | 5'-CGCAAGGGACCAGCUGAGG-3' | (SEQ ID NO: 4333) |
| CKAP5-4507 19 nt Target #2: | 5'-ACGCAAGGGACCAGCUGAG-3' | (SEQ ID NO: 4909) |
| CKAP5-4507 19 nt Target #3: | 5'-UACGCAAGGGACCAGCUGA-3' | (SEQ ID NO: 5485) |
| CKAP5-4591 19 nt Target #1: | 5'-CGCCGAGAAUUCCAGCUGG-3' | (SEQ ID NO: 4334) |
| CKAP5-4591 19 nt Target #2: | 5'-CCGCCGAGAAUUCCAGCUG-3' | (SEQ ID NO: 4910) |
| CKAP5-4591 19 nt Target #3: | 5'-UCCGCCGAGAAUUCCAGCU-3' | (SEQ ID NO: 5486) |
| CKAP5-4593 19 nt Target #1: | 5'-CCGAGAAUUCCAGCUGGAU-3' | (SEQ ID NO: 4335) |
| CKAP5-4593 19 nt Target #2: | 5'-GCCGAGAAUUCCAGCUGGA-3' | (SEQ ID NO: 4911) |
| CKAP5-4593 19 nt Target #3: | 5'-CGCCGAGAAUUCCAGCUGG-3' | (SEQ ID NO: 5487) |
| CKAP5-4718 19 nt Target #1: | 5'-AGAUCCGGGCUGUUUCUCC-3' | (SEQ ID NO: 4336) |
| CKAP5-4718 19 nt Target #2: | 5'-AAGAUCCGGGCUGUUUCUC-3' | (SEQ ID NO: 4912) |
| CKAP5-4718 19 nt Target #3: | 5'-CAAGAUCCGGGCUGUUUCU-3' | (SEQ ID NO: 5488) |

TABLE 7-continued

DsiRNA Component 19 Nucleotide Target Sequences In CKAP5 mRNA

| | | |
|---|---|---|
| CKAP5-4720 19 nt Target #1: | 5'-AUCCGGGCUGUUUCUCCAC-3' | (SEQ ID NO: 4337) |
| CKAP5-4720 19 nt Target #2: | 5'-GAUCCGGGCUGUUUCUCCA-3' | (SEQ ID NO: 4913) |
| CKAP5-4720 19 nt Target #3: | 5'-AGAUCCGGGCUGUUUCUCC-3' | (SEQ ID NO: 5489) |
| CKAP5-4744 19 nt Target #1: | 5'-GAUGACAUGCACAGUAAUA-3' | (SEQ ID NO: 4338) |
| CKAP5-4744 19 nt Target #2: | 5'-CGAUGACAUGCACAGUAAU-3' | (SEQ ID NO: 4914) |
| CKAP5-4744 19 nt Target #3: | 5'-UCGAUGACAUGCACAGUAA-3' | (SEQ ID NO: 5490) |
| CKAP5-4746 19 nt Target #1: | 5'-UGACAUGCACAGUAAUACA-3' | (SEQ ID NO: 4339) |
| CKAP5-4746 19 nt Target #2: | 5'-AUGACAUGCACAGUAAUAC-3' | (SEQ ID NO: 4915) |
| CKAP5-4746 19 nt Target #3: | 5'-GAUGACAUGCACAGUAAUA-3' | (SEQ ID NO: 5491) |
| CKAP5-4748 19 nt Target #1: | 5'-ACAUGCACAGUAAUACAGC-3' | (SEQ ID NO: 4340) |
| CKAP5-4748 19 nt Target #2: | 5'-GACAUGCACAGUAAUACAG-3' | (SEQ ID NO: 4916) |
| CKAP5-4748 19 nt Target #3: | 5'-UGACAUGCACAGUAAUACA-3' | (SEQ ID NO: 5492) |
| CKAP5-4750 19 nt Target #1: | 5'-AUGCACAGUAAUACAGCAU-3' | (SEQ ID NO: 4341) |
| CKAP5-4750 19 nt Target #2: | 5'-CAUGCACAGUAAUACAGCA-3' | (SEQ ID NO: 4917) |
| CKAP5-4750 19 nt Target #3: | 5'-ACAUGCACAGUAAUACAGC-3' | (SEQ ID NO: 5493) |
| CKAP5-4752 19 nt Target #1: | 5'-GCACAGUAAUACAGCAUCC-3' | (SEQ ID NO: 4342) |
| CKAP5-4752 19 nt Target #2: | 5'-UGCACAGUAAUACAGCAUC-3' | (SEQ ID NO: 4918) |
| CKAP5-4752 19 nt Target #3: | 5'-AUGCACAGUAAUACAGCAU-3' | (SEQ ID NO: 5494) |
| CKAP5-4754 19 nt Target #1: | 5'-ACAGUAAUACAGCAUCCAC-3' | (SEQ ID NO: 4343) |
| CKAP5-4754 19 nt Target #2: | 5'-CACAGUAAUACAGCAUCCA-3' | (SEQ ID NO: 4919) |
| CKAP5-4754 19 nt Target #3: | 5'-GCACAGUAAUACAGCAUCC-3' | (SEQ ID NO: 5495) |
| CKAP5-4756 19 nt Target #1: | 5'-AGUAAUACAGCAUCCACAA-3' | (SEQ ID NO: 4344) |
| CKAP5-4756 19 nt Target #2: | 5'-CAGUAAUACAGCAUCCACA-3' | (SEQ ID NO: 4920) |
| CKAP5-4756 19 nt Target #3: | 5'-ACAGUAAUACAGCAUCCAC-3' | (SEQ ID NO: 5496) |
| CKAP5-4758 19 nt Target #1: | 5'-UAAUACAGCAUCCACAAUC-3' | (SEQ ID NO: 4345) |
| CKAP5-4758 19 nt Target #2: | 5'-GUAAUACAGCAUCCACAAU-3' | (SEQ ID NO: 4921) |
| CKAP5-4758 19 nt Target #3: | 5'-AGUAAUACAGCAUCCACAA-3' | (SEQ ID NO: 5497) |
| CKAP5-4760 19 nt Target #1: | 5'-AUACAGCAUCCACAAUCAA-3' | (SEQ ID NO: 4346) |
| CKAP5-4760 19 nt Target #2: | 5'-AAUACAGCAUCCACAAUCA-3' | (SEQ ID NO: 4922) |
| CKAP5-4760 19 nt Target #3: | 5'-UAAUACAGCAUCCACAAUC-3' | (SEQ ID NO: 5498) |
| CKAP5-4762 19 nt Target #1: | 5'-ACAGCAUCCACAAUCAAUU-3' | (SEQ ID NO: 4347) |
| CKAP5-4762 19 nt Target #2: | 5'-UACAGCAUCCACAAUCAAU-3' | (SEQ ID NO: 4923) |
| CKAP5-4762 19 nt Target #3: | 5'-AUACAGCAUCCACAAUCAA-3' | (SEQ ID NO: 5499) |
| CKAP5-4764 19 nt Target #1: | 5'-AGCAUCCACAAUCAAUUUC-3' | (SEQ ID NO: 4348) |
| CKAP5-4764 19 nt Target #2: | 5'-CAGCAUCCACAAUCAAUUU-3' | (SEQ ID NO: 4924) |
| CKAP5-4764 19 nt Target #3: | 5'-ACAGCAUCCACAAUCAAUU-3' | (SEQ ID NO: 5500) |
| CKAP5-4766 19 nt Target #1: | 5'-CAUCCACAAUCAAUUUCAU-3' | (SEQ ID NO: 4349) |
| CKAP5-4766 19 nt Target #2: | 5'-GCAUCCACAAUCAAUUUCA-3' | (SEQ ID NO: 4925) |
| CKAP5-4766 19 nt Target #3: | 5'-AGCAUCCACAAUCAAUUUC-3' | (SEQ ID NO: 5501) |

TABLE 7-continued

DsiRNA Component 19 Nucleotide Target Sequences In CKAP5 mRNA

| | | |
|---|---|---|
| CKAP5-4768 19 nt Target #1: | 5'-UCCACAAUCAAUUUCAUUA-3' | (SEQ ID NO: 4350) |
| CKAP5-4768 19 nt Target #2: | 5'-AUCCACAAUCAAUUUCAUU-3' | (SEQ ID NO: 4926) |
| CKAP5-4768 19 nt Target #3: | 5'-CAUCCACAAUCAAUUUCAU-3' | (SEQ ID NO: 5502) |
| CKAP5-4770 19 nt Target #1: | 5'-CACAAUCAAUUUCAUUAUC-3' | (SEQ ID NO: 4351) |
| CKAP5-4770 19 nt Target #2: | 5'-CCACAAUCAAUUUCAUUAU-3' | (SEQ ID NO: 4927) |
| CKAP5-4770 19 nt Target #3: | 5'-UCCACAAUCAAUUUCAUUA-3' | (SEQ ID NO: 5503) |
| CKAP5-4772 19 nt Target #1: | 5'-CAAUCAAUUUCAUUAUCUC-3' | (SEQ ID NO: 4352) |
| CKAP5-4772 19 nt Target #2: | 5'-ACAAUCAAUUUCAUUAUCU-3' | (SEQ ID NO: 4928) |
| CKAP5-4772 19 nt Target #3: | 5'-CACAAUCAAUUUCAUUAUC-3' | (SEQ ID NO: 5504) |
| CKAP5-4774 19 nt Target #1: | 5'-AUCAAUUUCAUUAUCUCCC-3' | (SEQ ID NO: 4353) |
| CKAP5-4774 19 nt Target #2: | 5'-AAUCAAUUUCAUUAUCUCC-3' | (SEQ ID NO: 4929) |
| CKAP5-4774 19 nt Target #3: | 5'-CAAUCAAUUUCAUUAUCUC-3' | (SEQ ID NO: 5505) |
| CKAP5-4776 19 nt Target #1: | 5'-CAAUUUCAUUAUCUCCCAA-3' | (SEQ ID NO: 4354) |
| CKAP5-4776 19 nt Target #2: | 5'-UCAAUUUCAUUAUCUCCCA-3' | (SEQ ID NO: 4930) |
| CKAP5-4776 19 nt Target #3: | 5'-AUCAAUUUCAUUAUCUCCC-3' | (SEQ ID NO: 5506) |
| CKAP5-4778 19 nt Target #1: | 5'-AUUUCAUUAUCUCCCAAGU-3' | (SEQ ID NO: 4355) |
| CKAP5-4778 19 nt Target #2: | 5'-AAUUUCAUUAUCUCCCAAG-3' | (SEQ ID NO: 4931) |
| CKAP5-4778 19 nt Target #3: | 5'-CAAUUUCAUUAUCUCCCAA-3' | (SEQ ID NO: 5507) |
| CKAP5-4780 19 nt Target #1: | 5'-UUCAUUAUCUCCCAAGUAG-3' | (SEQ ID NO: 4356) |
| CKAP5-4780 19 nt Target #2: | 5'-UUUCAUUAUCUCCCAAGUA-3' | (SEQ ID NO: 4932) |
| CKAP5-4780 19 nt Target #3: | 5'-AUUUCAUUAUCUCCCAAGU-3' | (SEQ ID NO: 5508) |
| CKAP5-4782 19 nt Target #1: | 5'-CAUUAUCUCCCAAGUAGCC-3' | (SEQ ID NO: 4357) |
| CKAP5-4782 19 nt Target #2: | 5'-UCAUUAUCUCCCAAGUAGC-3' | (SEQ ID NO: 4933) |
| CKAP5-4782 19 nt Target #3: | 5'-UUCAUUAUCUCCCAAGUAG-3' | (SEQ ID NO: 5509) |
| CKAP5-4784 19 nt Target #1: | 5'-UUAUCUCCCAAGUAGCCAG-3' | (SEQ ID NO: 4358) |
| CKAP5-4784 19 nt Target #2: | 5'-AUUAUCUCCCAAGUAGCCA-3' | (SEQ ID NO: 4934) |
| CKAP5-4784 19 nt Target #3: | 5'-CAUUAUCUCCCAAGUAGCC-3' | (SEQ ID NO: 5510) |
| CKAP5-4786 19 nt Target #1: | 5'-AUCUCCCAAGUAGCCAGUG-3' | (SEQ ID NO: 4359) |
| CKAP5-4786 19 nt Target #2: | 5'-UAUCUCCCAAGUAGCCAGU-3' | (SEQ ID NO: 4935) |
| CKAP5-4786 19 nt Target #3: | 5'-UUAUCUCCCAAGUAGCCAG-3' | (SEQ ID NO: 5511) |
| CKAP5-4788 19 nt Target #1: | 5'-CUCCCAAGUAGCCAGUGGU-3' | (SEQ ID NO: 4360) |
| CKAP5-4788 19 nt Target #2: | 5'-UCUCCCAAGUAGCCAGUGG-3' | (SEQ ID NO: 4936) |
| CKAP5-4788 19 nt Target #3: | 5'-AUCUCCCAAGUAGCCAGUG-3' | (SEQ ID NO: 5512) |
| CKAP5-4790 19 nt Target #1: | 5'-CCCAAGUAGCCAGUGGUGA-3' | (SEQ ID NO: 4361) |
| CKAP5-4790 19 nt Target #2: | 5'-UCCCAAGUAGCCAGUGGUG-3' | (SEQ ID NO: 4937) |
| CKAP5-4790 19 nt Target #3: | 5'-CUCCCAAGUAGCCAGUGGU-3' | (SEQ ID NO: 5513) |
| CKAP5-4792 19 nt Target #1: | 5'-CAAGUAGCCAGUGGUGACA-3' | (SEQ ID NO: 4362) |
| CKAP5-4792 19 nt Target #2: | 5'-CCAAGUAGCCAGUGGUGAC-3' | (SEQ ID NO: 4938) |
| CKAP5-4792 19 nt Target #3: | 5'-CCCAAGUAGCCAGUGGUGA-3' | (SEQ ID NO: 5514) |

TABLE 7-continued

DsiRNA Component 19 Nucleotide Target Sequences In CKAP5 mRNA

| | | |
|---|---|---|
| CKAP5-5041 19 nt Target #1: | 5'-GCCCGGGAGGCCUCCACUG-3' | (SEQ ID NO: 4363) |
| CKAP5-5041 19 nt Target #2: | 5'-UGCCCGGGAGGCCUCCACU-3' | (SEQ ID NO: 4939) |
| CKAP5-5041 19 nt Target #3: | 5'-UUGCCCGGGAGGCCUCCAC-3' | (SEQ ID NO: 5515) |
| CKAP5-5043 19 nt Target #1: | 5'-CCGGGAGGCCUCCACUGGA-3' | (SEQ ID NO: 4364) |
| CKAP5-5043 19 nt Target #2: | 5'-CCCGGGAGGCCUCCACUGG-3' | (SEQ ID NO: 4940) |
| CKAP5-5043 19 nt Target #3: | 5'-GCCCGGGAGGCCUCCACUG-3' | (SEQ ID NO: 5516) |
| CKAP5-5045 19 nt Target #1: | 5'-GGGAGGCCUCCACUGGAGU-3' | (SEQ ID NO: 4365) |
| CKAP5-5045 19 nt Target #2: | 5'-CGGGAGGCCUCCACUGGAG-3' | (SEQ ID NO: 4941) |
| CKAP5-5045 19 nt Target #3: | 5'-CCGGGAGGCCUCCACUGGA-3' | (SEQ ID NO: 5517) |
| CKAP5-5047 19 nt Target #1: | 5'-GAGGCCUCCACUGGAGUAC-3' | (SEQ ID NO: 4366) |
| CKAP5-5047 19 nt Target #2: | 5'-GGAGGCCUCCACUGGAGUA-3' | (SEQ ID NO: 4942) |
| CKAP5-5047 19 nt Target #3: | 5'-GGGAGGCCUCCACUGGAGU-3' | (SEQ ID NO: 5518) |
| CKAP5-5089 19 nt Target #1: | 5'-AUCACCUUAAUGCUGGAUU-3' | (SEQ ID NO: 4367) |
| CKAP5-5089 19 nt Target #2: | 5'-CAUCACCUUAAUGCUGGAU-3' | (SEQ ID NO: 4943) |
| CKAP5-5089 19 nt Target #3: | 5'-UCAUCACCUUAAUGCUGGA-3' | (SEQ ID NO: 5519) |
| CKAP5-5091 19 nt Target #1: | 5'-CACCUUAAUGCUGGAUUCU-3' | (SEQ ID NO: 4368) |
| CKAP5-5091 19 nt Target #2: | 5'-UCACCUUAAUGCUGGAUUC-3' | (SEQ ID NO: 4944) |
| CKAP5-5091 19 nt Target #3: | 5'-AUCACCUUAAUGCUGGAUU-3' | (SEQ ID NO: 5520) |
| CKAP5-5093 19 nt Target #1: | 5'-CCUUAAUGCUGGAUUCUCG-3' | (SEQ ID NO: 4369) |
| CKAP5-5093 19 nt Target #2: | 5'-ACCUUAAUGCUGGAUUCUC-3' | (SEQ ID NO: 4945) |
| CKAP5-5093 19 nt Target #3: | 5'-CACCUUAAUGCUGGAUUCU-3' | (SEQ ID NO: 5521) |
| CKAP5-5095 19 nt Target #1: | 5'-UUAAUGCUGGAUUCUCGGA-3' | (SEQ ID NO: 4370) |
| CKAP5-5095 19 nt Target #2: | 5'-CUUAAUGCUGGAUUCUCGG-3' | (SEQ ID NO: 4946) |
| CKAP5-5095 19 nt Target #3: | 5'-CCUUAAUGCUGGAUUCUCG-3' | (SEQ ID NO: 5522) |
| CKAP5-5097 19 nt Target #1: | 5'-AAUGCUGGAUUCUCGGAUU-3' | (SEQ ID NO: 4371) |
| CKAP5-5097 19 nt Target #2: | 5'-UAAUGCUGGAUUCUCGGAU-3' | (SEQ ID NO: 4947) |
| CKAP5-5097 19 nt Target #3: | 5'-UUAAUGCUGGAUUCUCGGA-3' | (SEQ ID NO: 5523) |
| CKAP5-5099 19 nt Target #1: | 5'-UGCUGGAUUCUCGGAUUGA-3' | (SEQ ID NO: 4372) |
| CKAP5-5099 19 nt Target #2: | 5'-AUGCUGGAUUCUCGGAUUG-3' | (SEQ ID NO: 4948) |
| CKAP5-5099 19 nt Target #3: | 5'-AAUGCUGGAUUCUCGGAUU-3' | (SEQ ID NO: 5524) |
| CKAP5-5101 19 nt Target #1: | 5'-CUGGAUUCUCGGAUUGAAG-3' | (SEQ ID NO: 4373) |
| CKAP5-5101 19 nt Target #2: | 5'-GCUGGAUUCUCGGAUUGAA-3' | (SEQ ID NO: 4949) |
| CKAP5-5101 19 nt Target #3: | 5'-UGCUGGAUUCUCGGAUUGA-3' | (SEQ ID NO: 5525) |
| CKAP5-5103 19 nt Target #1: | 5'-GGAUUCUCGGAUUGAAGAU-3' | (SEQ ID NO: 4374) |
| CKAP5-5103 19 nt Target #2: | 5'-UGGAUUCUCGGAUUGAAGA-3' | (SEQ ID NO: 4950) |
| CKAP5-5103 19 nt Target #3: | 5'-CUGGAUUCUCGGAUUGAAG-3' | (SEQ ID NO: 5526) |
| CKAP5-5105 19 nt Target #1: | 5'-AUUCUCGGAUUGAAGAUCU-3' | (SEQ ID NO: 4375) |
| CKAP5-5105 19 nt Target #2: | 5'-GAUUCUCGGAUUGAAGAUC-3' | (SEQ ID NO: 4951) |
| CKAP5-5105 19 nt Target #3: | 5'-GGAUUCUCGGAUUGAAGAU-3' | (SEQ ID NO: 5527) |

TABLE 7-continued

DsiRNA Component 19 Nucleotide Target Sequences In CKAP5 mRNA

| | | |
|---|---|---|
| CKAP5-5150 19 nt Target #1: | 5'-CUGUGAACCUCUUGGUGGU-3' | (SEQ ID NO: 4376) |
| CKAP5-5150 19 nt Target #2: | 5'-UCUGUGAACCUCUUGGUGG-3' | (SEQ ID NO: 4952) |
| CKAP5-5150 19 nt Target #3: | 5'-CUCUGUGAACCUCUUGGUG-3' | (SEQ ID NO: 5528) |
| CKAP5-5152 19 nt Target #1: | 5'-GUGAACCUCUUGGUGGUGA-3' | (SEQ ID NO: 4377) |
| CKAP5-5152 19 nt Target #2: | 5'-UGUGAACCUCUUGGUGGUG-3' | (SEQ ID NO: 4953) |
| CKAP5-5152 19 nt Target #3: | 5'-CUGUGAACCUCUUGGUGGU-3' | (SEQ ID NO: 5529) |
| CKAP5-5154 19 nt Target #1: | 5'-GAACCUCUUGGUGGUGAAG-3' | (SEQ ID NO: 4378) |
| CKAP5-5154 19 nt Target #2: | 5'-UGAACCUCUUGGUGGUGAA-3' | (SEQ ID NO: 4954) |
| CKAP5-5154 19 nt Target #3: | 5'-GUGAACCUCUUGGUGGUGA-3' | (SEQ ID NO: 5530) |
| CKAP5-5156 19 nt Target #1: | 5'-ACCUCUUGGUGGUGAAGGU-3' | (SEQ ID NO: 4379) |
| CKAP5-5156 19 nt Target #2: | 5'-AACCUCUUGGUGGUGAAGG-3' | (SEQ ID NO: 4955) |
| CKAP5-5156 19 nt Target #3: | 5'-GAACCUCUUGGUGGUGAAG-3' | (SEQ ID NO: 5531) |
| CKAP5-5230 19 nt Target #1: | 5'-GACAGCCUGCUAGCAACAG-3' | (SEQ ID NO: 4380) |
| CKAP5-5230 19 nt Target #2: | 5'-AGACAGCCUGCUAGCAACA-3' | (SEQ ID NO: 4956) |
| CKAP5-5230 19 nt Target #3: | 5'-AAGACAGCCUGCUAGCAAC-3' | (SEQ ID NO: 5532) |
| CKAP5-5251 19 nt Target #1: | 5'-AGUUCUCCCAAAUUCUCAG-3' | (SEQ ID NO: 4381) |
| CKAP5-5251 19 nt Target #2: | 5'-CAGUUCUCCCAAAUUCUCA-3' | (SEQ ID NO: 4957) |
| CKAP5-5251 19 nt Target #3: | 5'-CCAGUUCUCCCAAAUUCUC-3' | (SEQ ID NO: 5533) |
| CKAP5-5253 19 nt Target #1: | 5'-UUCUCCCAAAUUCUCAGAG-3' | (SEQ ID NO: 4382) |
| CKAP5-5253 19 nt Target #2: | 5'-GUUCUCCCAAAUUCUCAGA-3' | (SEQ ID NO: 4958) |
| CKAP5-5253 19 nt Target #3: | 5'-AGUUCUCCCAAAUUCUCAG-3' | (SEQ ID NO: 5534) |
| CKAP5-5255 19 nt Target #1: | 5'-CUCCCAAAUUCUCAGAGCU-3' | (SEQ ID NO: 4383) |
| CKAP5-5255 19 nt Target #2: | 5'-UCUCCCAAAUUCUCAGAGC-3' | (SEQ ID NO: 4959) |
| CKAP5-5255 19 nt Target #3: | 5'-UUCUCCCAAAUUCUCAGAG-3' | (SEQ ID NO: 5535) |
| CKAP5-5257 19 nt Target #1: | 5'-CCCAAAUUCUCAGAGCUUG-3' | (SEQ ID NO: 4384) |
| CKAP5-5257 19 nt Target #2: | 5'-UCCCAAAUUCUCAGAGCUU-3' | (SEQ ID NO: 4960) |
| CKAP5-5257 19 nt Target #3: | 5'-CUCCCAAAUUCUCAGAGCU-3' | (SEQ ID NO: 5536) |
| CKAP5-5259 19 nt Target #1: | 5'-CAAAUUCUCAGAGCUUGUU-3' | (SEQ ID NO: 4385) |
| CKAP5-5259 19 nt Target #2: | 5'-CCAAAUUCUCAGAGCUUGU-3' | (SEQ ID NO: 4961) |
| CKAP5-5259 19 nt Target #3: | 5'-CCCAAAUUCUCAGAGCUUG-3' | (SEQ ID NO: 5537) |
| CKAP5-5261 19 nt Target #1: | 5'-AAUUCUCAGAGCUUGUUAU-3' | (SEQ ID NO: 4386) |
| CKAP5-5261 19 nt Target #2: | 5'-AAAUUCUCAGAGCUUGUUA-3' | (SEQ ID NO: 4962) |
| CKAP5-5261 19 nt Target #3: | 5'-CAAAUUCUCAGAGCUUGUU-3' | (SEQ ID NO: 5538) |
| CKAP5-5263 19 nt Target #1: | 5'-UUCUCAGAGCUUGUUAUGA-3' | (SEQ ID NO: 4387) |
| CKAP5-5263 19 nt Target #2: | 5'-AUUCUCAGAGCUUGUUAUG-3' | (SEQ ID NO: 4963) |
| CKAP5-5263 19 nt Target #3: | 5'-AAUUCUCAGAGCUUGUUAU-3' | (SEQ ID NO: 5539) |
| CKAP5-5265 19 nt Target #1: | 5'-CUCAGAGCUUGUUAUGAAG-3' | (SEQ ID NO: 4388) |
| CKAP5-5265 19 nt Target #2: | 5'-UCUCAGAGCUUGUUAUGAA-3' | (SEQ ID NO: 4964) |
| CKAP5-5265 19 nt Target #3: | 5'-UUCUCAGAGCUUGUUAUGA-3' | (SEQ ID NO: 5540) |

TABLE 7-continued

DsiRNA Component 19 Nucleotide Target Sequences In CKAP5 mRNA

| | | |
|---|---|---|
| CKAP5-5267 19 nt Target #1: | 5'-CAGAGCUUGUUAUGAAGUG-3' | (SEQ ID NO: 4389) |
| CKAP5-5267 19 nt Target #2: | 5'-UCAGAGCUUGUUAUGAAGU-3' | (SEQ ID NO: 4965) |
| CKAP5-5267 19 nt Target #3: | 5'-CUCAGAGCUUGUUAUGAAG-3' | (SEQ ID NO: 5541) |
| CKAP5-5269 19 nt Target #1: | 5'-GAGCUUGUUAUGAAGUGUC-3' | (SEQ ID NO: 4390) |
| CKAP5-5269 19 nt Target #2: | 5'-AGAGCUUGUUAUGAAGUGU-3' | (SEQ ID NO: 4966) |
| CKAP5-5269 19 nt Target #3: | 5'-CAGAGCUUGUUAUGAAGUG-3' | (SEQ ID NO: 5542) |
| CKAP5-5326 19 nt Target #1: | 5'-AGCAUUAACCUAGACAGAA-3' | (SEQ ID NO: 4391) |
| CKAP5-5326 19 nt Target #2: | 5'-UAGCAUUAACCUAGACAGA-3' | (SEQ ID NO: 4967) |
| CKAP5-5326 19 nt Target #3: | 5'-AUAGCAUUAACCUAGACAG-3' | (SEQ ID NO: 5543) |
| CKAP5-5328 19 nt Target #1: | 5'-CAUUAACCUAGACAGAAUU-3' | (SEQ ID NO: 4392) |
| CKAP5-5328 19 nt Target #2: | 5'-GCAUUAACCUAGACAGAAU-3' | (SEQ ID NO: 4968) |
| CKAP5-5328 19 nt Target #3: | 5'-AGCAUUAACCUAGACAGAA-3' | (SEQ ID NO: 5544) |
| CKAP5-5330 19 nt Target #1: | 5'-UUAACCUAGACAGAAUUCU-3' | (SEQ ID NO: 4393) |
| CKAP5-5330 19 nt Target #2: | 5'-AUUAACCUAGACAGAAUUC-3' | (SEQ ID NO: 4969) |
| CKAP5-5330 19 nt Target #3: | 5'-CAUUAACCUAGACAGAAUU-3' | (SEQ ID NO: 5545) |
| CKAP5-5332 19 nt Target #1: | 5'-AACCUAGACAGAAUUCUUC-3' | (SEQ ID NO: 4394) |
| CKAP5-5332 19 nt Target #2: | 5'-UAACCUAGACAGAAUUCUU-3' | (SEQ ID NO: 4970) |
| CKAP5-5332 19 nt Target #3: | 5'-UUAACCUAGACAGAAUUCU-3' | (SEQ ID NO: 5546) |
| CKAP5-5334 19 nt Target #1: | 5'-CCUAGACAGAAUUCUUCUG-3' | (SEQ ID NO: 4395) |
| CKAP5-5334 19 nt Target #2: | 5'-ACCUAGACAGAAUUCUUCU-3' | (SEQ ID NO: 4971) |
| CKAP5-5334 19 nt Target #3: | 5'-AACCUAGACAGAAUUCUUC-3' | (SEQ ID NO: 5547) |
| CKAP5-5336 19 nt Target #1: | 5'-UAGACAGAAUUCUUCUGGA-3' | (SEQ ID NO: 4396) |
| CKAP5-5336 19 nt Target #2: | 5'-CUAGACAGAAUUCUUCUGG-3' | (SEQ ID NO: 4972) |
| CKAP5-5336 19 nt Target #3: | 5'-CCUAGACAGAAUUCUUCUG-3' | (SEQ ID NO: 5548) |
| CKAP5-5357 19 nt Target #1: | 5'-UCCACAUUUUCAUGAAGGU-3' | (SEQ ID NO: 4397) |
| CKAP5-5357 19 nt Target #2: | 5'-AUCCACAUUUUCAUGAAGG-3' | (SEQ ID NO: 4973) |
| CKAP5-5357 19 nt Target #3: | 5'-UAUCCACAUUUUCAUGAAG-3' | (SEQ ID NO: 5549) |
| CKAP5-5394 19 nt Target #1: | 5'-GAAGCAAUGCAAAAGUGAA-3' | (SEQ ID NO: 4398) |
| CKAP5-5394 19 nt Target #2: | 5'-UGAAGCAAUGCAAAAGUGA-3' | (SEQ ID NO: 4974) |
| CKAP5-5394 19 nt Target #3: | 5'-CUGAAGCAAUGCAAAAGUG-3' | (SEQ ID NO: 5550) |
| CKAP5-5396 19 nt Target #1: | 5'-AGCAAUGCAAAAGUGAAUU-3' | (SEQ ID NO: 4399) |
| CKAP5-5396 19 nt Target #2: | 5'-AAGCAAUGCAAAAGUGAAU-3' | (SEQ ID NO: 4975) |
| CKAP5-5396 19 nt Target #3: | 5'-GAAGCAAUGCAAAAGUGAA-3' | (SEQ ID NO: 5551) |
| CKAP5-5398 19 nt Target #1: | 5'-CAAUGCAAAAGUGAAUUUC-3' | (SEQ ID NO: 4400) |
| CKAP5-5398 19 nt Target #2: | 5'-GCAAUGCAAAAGUGAAUUU-3' | (SEQ ID NO: 4976) |
| CKAP5-5398 19 nt Target #3: | 5'-AGCAAUGCAAAAGUGAAUU-3' | (SEQ ID NO: 5552) |
| CKAP5-5551 19 nt Target #1: | 5'-AGUAUGGACCAGACUGGGA-3' | (SEQ ID NO: 4401) |
| CKAP5-5551 19 nt Target #2: | 5'-CAGUAUGGACCAGACUGGG-3' | (SEQ ID NO: 4977) |
| CKAP5-5551 19 nt Target #3: | 5'-ACAGUAUGGACCAGACUGG-3' | (SEQ ID NO: 5553) |

TABLE 7-continued

DsiRNA Component 19 Nucleotide Target Sequences In CKAP5 mRNA

| | | |
|---|---|---|
| CKAP5-5553 19 nt Target #1: | 5'-UAUGGACCAGACUGGGAGC-3' | (SEQ ID NO: 4402) |
| CKAP5-5553 19 nt Target #2: | 5'-GUAUGGACCAGACUGGGAG-3' | (SEQ ID NO: 4978) |
| CKAP5-5553 19 nt Target #3: | 5'-AGUAUGGACCAGACUGGGA-3' | (SEQ ID NO: 5554) |
| CKAP5-5555 19 nt Target #1: | 5'-UGGACCAGACUGGGAGCAA-3' | (SEQ ID NO: 4403) |
| CKAP5-5555 19 nt Target #2: | 5'-AUGGACCAGACUGGGAGCA-3' | (SEQ ID NO: 4979) |
| CKAP5-5555 19 nt Target #3: | 5'-UAUGGACCAGACUGGGAGC-3' | (SEQ ID NO: 5555) |
| CKAP5-5557 19 nt Target #1: | 5'-GACCAGACUGGGAGCAAGU-3' | (SEQ ID NO: 4404) |
| CKAP5-5557 19 nt Target #2: | 5'-GGACCAGACUGGGAGCAAG-3' | (SEQ ID NO: 4980) |
| CKAP5-5557 19 nt Target #3: | 5'-UGGACCAGACUGGGAGCAA-3' | (SEQ ID NO: 5556) |
| CKAP5-5559 19 nt Target #1: | 5'-CCAGACUGGGAGCAAGUCU-3' | (SEQ ID NO: 4405) |
| CKAP5-5559 19 nt Target #2: | 5'-ACCAGACUGGGAGCAAGUC-3' | (SEQ ID NO: 4981) |
| CKAP5-5559 19 nt Target #3: | 5'-GACCAGACUGGGAGCAAGU-3' | (SEQ ID NO: 5557) |
| CKAP5-5561 19 nt Target #1: | 5'-AGACUGGGAGCAAGUCUGA-3' | (SEQ ID NO: 4406) |
| CKAP5-5561 19 nt Target #2: | 5'-CAGACUGGGAGCAAGUCUG-3' | (SEQ ID NO: 4982) |
| CKAP5-5561 19 nt Target #3: | 5'-CCAGACUGGGAGCAAGUCU-3' | (SEQ ID NO: 5558) |
| CKAP5-5563 19 nt Target #1: | 5'-ACUGGGAGCAAGUCUGAUA-3' | (SEQ ID NO: 4407) |
| CKAP5-5563 19 nt Target #2: | 5'-GACUGGGAGCAAGUCUGAU-3' | (SEQ ID NO: 4983) |
| CKAP5-5563 19 nt Target #3: | 5'-AGACUGGGAGCAAGUCUGA-3' | (SEQ ID NO: 5559) |
| CKAP5-5565 19 nt Target #1: | 5'-UGGGAGCAAGUCUGAUAAG-3' | (SEQ ID NO: 4408) |
| CKAP5-5565 19 nt Target #2: | 5'-CUGGGAGCAAGUCUGAUAA-3' | (SEQ ID NO: 4984) |
| CKAP5-5565 19 nt Target #3: | 5'-ACUGGGAGCAAGUCUGAUA-3' | (SEQ ID NO: 5560) |
| CKAP5-5567 19 nt Target #1: | 5'-GGAGCAAGUCUGAUAAGGA-3' | (SEQ ID NO: 4409) |
| CKAP5-5567 19 nt Target #2: | 5'-GGGAGCAAGUCUGAUAAGG-3' | (SEQ ID NO: 4985) |
| CKAP5-5567 19 nt Target #3: | 5'-UGGGAGCAAGUCUGAUAAG-3' | (SEQ ID NO: 5561) |
| CKAP5-5569 19 nt Target #1: | 5'-AGCAAGUCUGAUAAGGAAA-3' | (SEQ ID NO: 4410) |
| CKAP5-5569 19 nt Target #2: | 5'-GAGCAAGUCUGAUAAGGAA-3' | (SEQ ID NO: 4986) |
| CKAP5-5569 19 nt Target #3: | 5'-GGAGCAAGUCUGAUAAGGA-3' | (SEQ ID NO: 5562) |
| CKAP5-5571 19 nt Target #1: | 5'-CAAGUCUGAUAAGGAAACA-3' | (SEQ ID NO: 4411) |
| CKAP5-5571 19 nt Target #2: | 5'-GCAAGUCUGAUAAGGAAAC-3' | (SEQ ID NO: 4987) |
| CKAP5-5571 19 nt Target #3: | 5'-AGCAAGUCUGAUAAGGAAA-3' | (SEQ ID NO: 5563) |
| CKAP5-5573 19 nt Target #1: | 5'-AGUCUGAUAAGGAAACAGA-3' | (SEQ ID NO: 4412) |
| CKAP5-5573 19 nt Target #2: | 5'-AAGUCUGAUAAGGAAACAG-3' | (SEQ ID NO: 4988) |
| CKAP5-5573 19 nt Target #3: | 5'-CAAGUCUGAUAAGGAAACA-3' | (SEQ ID NO: 5564) |
| CKAP5-5575 19 nt Target #1: | 5'-UCUGAUAAGGAAACAGAAA-3' | (SEQ ID NO: 4413) |
| CKAP5-5575 19 nt Target #2: | 5'-GUCUGAUAAGGAAACAGAA-3' | (SEQ ID NO: 4989) |
| CKAP5-5575 19 nt Target #3: | 5'-AGUCUGAUAAGGAAACAGA-3' | (SEQ ID NO: 5565) |
| CKAP5-5577 19 nt Target #1: | 5'-UGAUAAGGAAACAGAAAAG-3' | (SEQ ID NO: 4414) |
| CKAP5-5577 19 nt Target #2: | 5'-CUGAUAAGGAAACAGAAAA-3' | (SEQ ID NO: 4990) |
| CKAP5-5577 19 nt Target #3: | 5'-UCUGAUAAGGAAACAGAAA-3' | (SEQ ID NO: 5566) |

TABLE 7-continued

DsiRNA Component 19 Nucleotide Target Sequences In CKAP5 mRNA

| | |
|---|---|
| CKAP5-5579 19 nt Target #1: 5'-AUAAGGAAACAGAAAAGGG-3' | (SEQ ID NO: 4415) |
| CKAP5-5579 19 nt Target #2: 5'-GAUAAGGAAACAGAAAAGG-3' | (SEQ ID NO: 4991) |
| CKAP5-5579 19 nt Target #3: 5'-UGAUAAGGAAACAGAAAAG-3' | (SEQ ID NO: 5567) |
| CKAP5-5581 19 nt Target #1: 5'-AAGGAAACAGAAAAGGGAG-3' | (SEQ ID NO: 4416) |
| CKAP5-5581 19 nt Target #2: 5'-UAAGGAAACAGAAAAGGGA-3' | (SEQ ID NO: 4992) |
| CKAP5-5581 19 nt Target #3: 5'-AUAAGGAAACAGAAAAGGG-3' | (SEQ ID NO: 5568) |
| CKAP5-5602 19 nt Target #1: 5'-UCUCGAAUAGAUGAAAAAU-3' | (SEQ ID NO: 4417) |
| CKAP5-5602 19 nt Target #2: 5'-AUCUCGAAUAGAUGAAAAA-3' | (SEQ ID NO: 4993) |
| CKAP5-5602 19 nt Target #3: 5'-CAUCUCGAAUAGAUGAAAA-3' | (SEQ ID NO: 5569) |
| CKAP5-5604 19 nt Target #1: 5'-UCGAAUAGAUGAAAAAUCA-3' | (SEQ ID NO: 4418) |
| CKAP5-5604 19 nt Target #2: 5'-CUCGAAUAGAUGAAAAAUC-3' | (SEQ ID NO: 4994) |
| CKAP5-5604 19 nt Target #3: 5'-UCUCGAAUAGAUGAAAAAU-3' | (SEQ ID NO: 5570) |
| CKAP5-5606 19 nt Target #1: 5'-GAAUAGAUGAAAAAUCAUC-3' | (SEQ ID NO: 4419) |
| CKAP5-5606 19 nt Target #2: 5'-CGAAUAGAUGAAAAAUCAU-3' | (SEQ ID NO: 4995) |
| CKAP5-5606 19 nt Target #3: 5'-UCGAAUAGAUGAAAAAUCA-3' | (SEQ ID NO: 5571) |
| CKAP5-5608 19 nt Target #1: 5'-AUAGAUGAAAAAUCAUCAA-3' | (SEQ ID NO: 4420) |
| CKAP5-5608 19 nt Target #2: 5'-AAUAGAUGAAAAAUCAUCA-3' | (SEQ ID NO: 4996) |
| CKAP5-5608 19 nt Target #3: 5'-GAAUAGAUGAAAAAUCAUC-3' | (SEQ ID NO: 5572) |
| CKAP5-5610 19 nt Target #1: 5'-AGAUGAAAAAUCAUCAAAG-3' | (SEQ ID NO: 4421) |
| CKAP5-5610 19 nt Target #2: 5'-UAGAUGAAAAAUCAUCAAA-3' | (SEQ ID NO: 4997) |
| CKAP5-5610 19 nt Target #3: 5'-AUAGAUGAAAAAUCAUCAA-3' | (SEQ ID NO: 5573) |
| CKAP5-5612 19 nt Target #1: 5'-AUGAAAAAUCAUCAAAGGC-3' | (SEQ ID NO: 4422) |
| CKAP5-5612 19 nt Target #2: 5'-GAUGAAAAAUCAUCAAAGG-3' | (SEQ ID NO: 4998) |
| CKAP5-5612 19 nt Target #3: 5'-AGAUGAAAAAUCAUCAAAG-3' | (SEQ ID NO: 5574) |
| CKAP5-5614 19 nt Target #1: 5'-GAAAAAUCAUCAAAGGCCA-3' | (SEQ ID NO: 4423) |
| CKAP5-5614 19 nt Target #2: 5'-UGAAAAAUCAUCAAAGGCC-3' | (SEQ ID NO: 4999) |
| CKAP5-5614 19 nt Target #3: 5'-AUGAAAAAUCAUCAAAGGC-3' | (SEQ ID NO: 5575) |
| CKAP5-5616 19 nt Target #1: 5'-AAAAUCAUCAAAGGCCAAA-3' | (SEQ ID NO: 4424) |
| CKAP5-5616 19 nt Target #2: 5'-AAAAAUCAUCAAAGGCCAA-3' | (SEQ ID NO: 5000) |
| CKAP5-5616 19 nt Target #3: 5'-GAAAAAUCAUCAAAGGCCA-3' | (SEQ ID NO: 5576) |
| CKAP5-5618 19 nt Target #1: 5'-AAUCAUCAAAGGCCAAAGU-3' | (SEQ ID NO: 4425) |
| CKAP5-5618 19 nt Target #2: 5'-AAAUCAUCAAAGGCCAAAG-3' | (SEQ ID NO: 5001) |
| CKAP5-5618 19 nt Target #3: 5'-AAAAUCAUCAAAGGCCAAA-3' | (SEQ ID NO: 5577) |
| CKAP5-5639 19 nt Target #1: 5'-AUGAUUUCUUAGCUGAGAU-3' | (SEQ ID NO: 4426) |
| CKAP5-5639 19 nt Target #2: 5'-AAUGAUUUCUUAGCUGAGA-3' | (SEQ ID NO: 5002) |
| CKAP5-5639 19 nt Target #3: 5'-GAAUGAUUUCUUAGCUGAG-3' | (SEQ ID NO: 5578) |
| CKAP5-5641 19 nt Target #1: 5'-GAUUUCUUAGCUGAGAUUU-3' | (SEQ ID NO: 4427) |
| CKAP5-5641 19 nt Target #2: 5'-UGAUUUCUUAGCUGAGAUU-3' | (SEQ ID NO: 5003) |
| CKAP5-5641 19 nt Target #3: 5'-AUGAUUUCUUAGCUGAGAU-3' | (SEQ ID NO: 5579) |

TABLE 7-continued

DsiRNA Component 19 Nucleotide Target Sequences In CKAP5 mRNA

| | | |
|---|---|---|
| CKAP5-5643 19 nt Target #1: | 5'-UUUCUUAGCUGAGAUUUUU-3' | (SEQ ID NO: 4428) |
| CKAP5-5643 19 nt Target #2: | 5'-AUUUCUUAGCUGAGAUUUU-3' | (SEQ ID NO: 5004) |
| CKAP5-5643 19 nt Target #3: | 5'-GAUUUCUUAGCUGAGAUUU-3' | (SEQ ID NO: 5580) |
| CKAP5-5645 19 nt Target #1: | 5'-UCUUAGCUGAGAUUUUUAA-3' | (SEQ ID NO: 4429) |
| CKAP5-5645 19 nt Target #2: | 5'-UUCUUAGCUGAGAUUUUUA-3' | (SEQ ID NO: 5005) |
| CKAP5-5645 19 nt Target #3: | 5'-UUUCUUAGCUGAGAUUUUU-3' | (SEQ ID NO: 5581) |
| CKAP5-5647 19 nt Target #1: | 5'-UUAGCUGAGAUUUUUAAGA-3' | (SEQ ID NO: 4430) |
| CKAP5-5647 19 nt Target #2: | 5'-CUUAGCUGAGAUUUUUAAG-3' | (SEQ ID NO: 5006) |
| CKAP5-5647 19 nt Target #3: | 5'-UCUUAGCUGAGAUUUUUAA-3' | (SEQ ID NO: 5582) |
| CKAP5-5649 19 nt Target #1: | 5'-AGCUGAGAUUUUUAAGAAG-3' | (SEQ ID NO: 4431) |
| CKAP5-5649 19 nt Target #2: | 5'-UAGCUGAGAUUUUUAAGAA-3' | (SEQ ID NO: 5007) |
| CKAP5-5649 19 nt Target #3: | 5'-UUAGCUGAGAUUUUUAAGA-3' | (SEQ ID NO: 5583) |
| CKAP5-5651 19 nt Target #1: | 5'-CUGAGAUUUUUAAGAAGAU-3' | (SEQ ID NO: 4432) |
| CKAP5-5651 19 nt Target #2: | 5'-GCUGAGAUUUUUAAGAAGA-3' | (SEQ ID NO: 5008) |
| CKAP5-5651 19 nt Target #3: | 5'-AGCUGAGAUUUUUAAGAAG-3' | (SEQ ID NO: 5584) |
| CKAP5-5653 19 nt Target #1: | 5'-GAGAUUUUUAAGAAGAUUG-3' | (SEQ ID NO: 4433) |
| CKAP5-5653 19 nt Target #2: | 5'-UGAGAUUUUUAAGAAGAUU-3' | (SEQ ID NO: 5009) |
| CKAP5-5653 19 nt Target #3: | 5'-CUGAGAUUUUUAAGAAGAU-3' | (SEQ ID NO: 5585) |
| CKAP5-5655 19 nt Target #1: | 5'-GAUUUUUAAGAAGAUUGGC-3' | (SEQ ID NO: 4434) |
| CKAP5-5655 19 nt Target #2: | 5'-AGAUUUUUAAGAAGAUUGG-3' | (SEQ ID NO: 5010) |
| CKAP5-5655 19 nt Target #3: | 5'-GAGAUUUUUAAGAAGAUUG-3' | (SEQ ID NO: 5586) |
| CKAP5-5657 19 nt Target #1: | 5'-UUUUUAAGAAGAUUGGCUC-3' | (SEQ ID NO: 4435) |
| CKAP5-5657 19 nt Target #2: | 5'-AUUUUUAAGAAGAUUGGCU-3' | (SEQ ID NO: 5011) |
| CKAP5-5657 19 nt Target #3: | 5'-GAUUUUUAAGAAGAUUGGC-3' | (SEQ ID NO: 5587) |
| CKAP5-5699 19 nt Target #1: | 5'-UAGCAGAGUUAUAUGAAUA-3' | (SEQ ID NO: 4436) |
| CKAP5-5699 19 nt Target #2: | 5'-CUAGCAGAGUUAUAUGAAU-3' | (SEQ ID NO: 5012) |
| CKAP5-5699 19 nt Target #3: | 5'-ACUAGCAGAGUUAUAUGAA-3' | (SEQ ID NO: 5588) |
| CKAP5-5701 19 nt Target #1: | 5'-GCAGAGUUAUAUGAAUAUA-3' | (SEQ ID NO: 4437) |
| CKAP5-5701 19 nt Target #2: | 5'-AGCAGAGUUAUAUGAAUAU-3' | (SEQ ID NO: 5013) |
| CKAP5-5701 19 nt Target #3: | 5'-UAGCAGAGUUAUAUGAAUA-3' | (SEQ ID NO: 5589) |
| CKAP5-5703 19 nt Target #1: | 5'-AGAGUUAUAUGAAUAUAAG-3' | (SEQ ID NO: 4438) |
| CKAP5-5703 19 nt Target #2: | 5'-CAGAGUUAUAUGAAUAUAA-3' | (SEQ ID NO: 5014) |
| CKAP5-5703 19 nt Target #3: | 5'-GCAGAGUUAUAUGAAUAUA-3' | (SEQ ID NO: 5590) |
| CKAP5-5705 19 nt Target #1: | 5'-AGUUAUAUGAAUAUAAGAA-3' | (SEQ ID NO: 4439) |
| CKAP5-5705 19 nt Target #2: | 5'-GAGUUAUAUGAAUAUAAGA-3' | (SEQ ID NO: 5015) |
| CKAP5-5705 19 nt Target #3: | 5'-AGAGUUAUAUGAAUAUAAG-3' | (SEQ ID NO: 5591) |
| CKAP5-5707 19 nt Target #1: | 5'-UUAUAUGAAUAUAAGAAGA-3' | (SEQ ID NO: 4440) |
| CKAP5-5707 19 nt Target #2: | 5'-GUUAUAUGAAUAUAAGAAG-3' | (SEQ ID NO: 5016) |
| CKAP5-5707 19 nt Target #3: | 5'-AGUUAUAUGAAUAUAAGAA-3' | (SEQ ID NO: 5592) |

TABLE 7-continued

DsiRNA Component 19 Nucleotide Target Sequences In CKAP5 mRNA

| | | |
|---|---|---|
| CKAP5-5709 19 nt Target #1: | 5'-AUAUGAAUAUAAGAAGAAA-3' | (SEQ ID NO: 4441) |
| CKAP5-5709 19 nt Target #2: | 5'-UAUAUGAAUAUAAGAAGAA-3' | (SEQ ID NO: 5017) |
| CKAP5-5709 19 nt Target #3: | 5'-UUAUAUGAAUAUAAGAAGA-3' | (SEQ ID NO: 5593) |
| CKAP5-5711 19 nt Target #1: | 5'-AUGAAUAUAAGAAGAAAUA-3' | (SEQ ID NO: 4442) |
| CKAP5-5711 19 nt Target #2: | 5'-UAUGAAUAUAAGAAGAAAU-3' | (SEQ ID NO: 5018) |
| CKAP5-5711 19 nt Target #3: | 5'-AUAUGAAUAUAAGAAGAAA-3' | (SEQ ID NO: 5594) |
| CKAP5-5739 19 nt Target #1: | 5'-UGACAUUGAACCAUUUCUG-3' | (SEQ ID NO: 4443) |
| CKAP5-5739 19 nt Target #2: | 5'-CUGACAUUGAACCAUUUCU-3' | (SEQ ID NO: 5019) |
| CKAP5-5739 19 nt Target #3: | 5'-GCUGACAUUGAACCAUUUC-3' | (SEQ ID NO: 5595) |
| CKAP5-5741 19 nt Target #1: | 5'-ACAUUGAACCAUUUCUGAA-3' | (SEQ ID NO: 4444) |
| CKAP5-5741 19 nt Target #2: | 5'-GACAUUGAACCAUUUCUGA-3' | (SEQ ID NO: 5020) |
| CKAP5-5741 19 nt Target #3: | 5'-UGACAUUGAACCAUUUCUG-3' | (SEQ ID NO: 5596) |
| CKAP5-5743 19 nt Target #1: | 5'-AUUGAACCAUUUCUGAAAA-3' | (SEQ ID NO: 4445) |
| CKAP5-5743 19 nt Target #2: | 5'-CAUUGAACCAUUUCUGAAA-3' | (SEQ ID NO: 5021) |
| CKAP5-5743 19 nt Target #3: | 5'-ACAUUGAACCAUUUCUGAA-3' | (SEQ ID NO: 5597) |
| CKAP5-5745 19 nt Target #1: | 5'-UGAACCAUUUCUGAAAAAU-3' | (SEQ ID NO: 4446) |
| CKAP5-5745 19 nt Target #2: | 5'-UUGAACCAUUUCUGAAAAA-3' | (SEQ ID NO: 5022) |
| CKAP5-5745 19 nt Target #3: | 5'-AUUGAACCAUUUCUGAAAA-3' | (SEQ ID NO: 5598) |
| CKAP5-5747 19 nt Target #1: | 5'-AACCAUUUCUGAAAAAUUC-3' | (SEQ ID NO: 4447) |
| CKAP5-5747 19 nt Target #2: | 5'-GAACCAUUUCUGAAAAAUU-3' | (SEQ ID NO: 5023) |
| CKAP5-5747 19 nt Target #3: | 5'-UGAACCAUUUCUGAAAAAU-3' | (SEQ ID NO: 5599) |
| CKAP5-5749 19 nt Target #1: | 5'-CCAUUUCUGAAAAAUUCCU-3' | (SEQ ID NO: 4448) |
| CKAP5-5749 19 nt Target #2: | 5'-ACCAUUUCUGAAAAAUUCC-3' | (SEQ ID NO: 5024) |
| CKAP5-5749 19 nt Target #3: | 5'-AACCAUUUCUGAAAAAUUC-3' | (SEQ ID NO: 5600) |
| CKAP5-5794 19 nt Target #1: | 5'-AGAGGCCUUCGGGUGAUUG-3' | (SEQ ID NO: 4449) |
| CKAP5-5794 19 nt Target #2: | 5'-AAGAGGCCUUCGGGUGAUU-3' | (SEQ ID NO: 5025) |
| CKAP5-5794 19 nt Target #3: | 5'-AAAGAGGCCUUCGGGUGAU-3' | (SEQ ID NO: 5601) |
| CKAP5-5796 19 nt Target #1: | 5'-AGGCCUUCGGGUGAUUGAG-3' | (SEQ ID NO: 4450) |
| CKAP5-5796 19 nt Target #2: | 5'-GAGGCCUUCGGGUGAUUGA-3' | (SEQ ID NO: 5026) |
| CKAP5-5796 19 nt Target #3: | 5'-AGAGGCCUUCGGGUGAUUG-3' | (SEQ ID NO: 5602) |
| CKAP5-5798 19 nt Target #1: | 5'-GCCUUCGGGUGAUUGAGAU-3' | (SEQ ID NO: 4451) |
| CKAP5-5798 19 nt Target #2: | 5'-GGCCUUCGGGUGAUUGAGA-3' | (SEQ ID NO: 5027) |
| CKAP5-5798 19 nt Target #3: | 5'-AGGCCUUCGGGUGAUUGAG-3' | (SEQ ID NO: 5603) |
| CKAP5-5800 19 nt Target #1: | 5'-CUUCGGGUGAUUGAGAUGG-3' | (SEQ ID NO: 4452) |
| CKAP5-5800 19 nt Target #2: | 5'-CCUUCGGGUGAUUGAGAUG-3' | (SEQ ID NO: 5028) |
| CKAP5-5800 19 nt Target #3: | 5'-GCCUUCGGGUGAUUGAGAU-3' | (SEQ ID NO: 5604) |
| CKAP5-5802 19 nt Target #1: | 5'-UCGGGUGAUUGAGAUGGAG-3' | (SEQ ID NO: 4453) |
| CKAP5-5802 19 nt Target #2: | 5'-UUCGGGUGAUUGAGAUGGA-3' | (SEQ ID NO: 5029) |
| CKAP5-5802 19 nt Target #3: | 5'-CUUCGGGUGAUUGAGAUGG-3' | (SEQ ID NO: 5605) |

TABLE 7-continued

DsiRNA Component 19 Nucleotide Target Sequences In CKAP5 mRNA

| | | |
|---|---|---|
| CKAP5-5804 19 nt Target #1: | 5'-GGGUGAUUGAGAUGGAGAG-3' | (SEQ ID NO: 4454) |
| CKAP5-5804 19 nt Target #2: | 5'-CGGGUGAUUGAGAUGGAGA-3' | (SEQ ID NO: 5030) |
| CKAP5-5804 19 nt Target #3: | 5'-UCGGGUGAUUGAGAUGGAG-3' | (SEQ ID NO: 5606) |
| CKAP5-5944 19 nt Target #1: | 5'-CCAUCUGUCUACUUGGAAA-3' | (SEQ ID NO: 4455) |
| CKAP5-5944 19 nt Target #2: | 5'-GCCAUCUGUCUACUUGGAA-3' | (SEQ ID NO: 5031) |
| CKAP5-5944 19 nt Target #3: | 5'-GGCCAUCUGUCUACUUGGA-3' | (SEQ ID NO: 5607) |
| CKAP5-5946 19 nt Target #1: | 5'-AUCUGUCUACUUGGAAAGG-3' | (SEQ ID NO: 4456) |
| CKAP5-5946 19 nt Target #2: | 5'-CAUCUGUCUACUUGGAAAG-3' | (SEQ ID NO: 5032) |
| CKAP5-5946 19 nt Target #3: | 5'-CCAUCUGUCUACUUGGAAA-3' | (SEQ ID NO: 5608) |
| CKAP5-5948 19 nt Target #1: | 5'-CUGUCUACUUGGAAAGGCU-3' | (SEQ ID NO: 4457) |
| CKAP5-5948 19 nt Target #2: | 5'-UCUGUCUACUUGGAAAGGC-3' | (SEQ ID NO: 5033) |
| CKAP5-5948 19 nt Target #3: | 5'-AUCUGUCUACUUGGAAAGG-3' | (SEQ ID NO: 5609) |
| CKAP5-5950 19 nt Target #1: | 5'-GUCUACUUGGAAAGGCUAA-3' | (SEQ ID NO: 4458) |
| CKAP5-5950 19 nt Target #2: | 5'-UGUCUACUUGGAAAGGCUA-3' | (SEQ ID NO: 5034) |
| CKAP5-5950 19 nt Target #3: | 5'-CUGUCUACUUGGAAAGGCU-3' | (SEQ ID NO: 5610) |
| CKAP5-6026 19 nt Target #1: | 5'-UGACCUCUUUGCUCUCCAA-3' | (SEQ ID NO: 4459) |
| CKAP5-6026 19 nt Target #2: | 5'-UUGACCUCUUUGCUCUCCA-3' | (SEQ ID NO: 5035) |
| CKAP5-6026 19 nt Target #3: | 5'-UUUGACCUCUUUGCUCUCC-3' | (SEQ ID NO: 5611) |
| CKAP5-6028 19 nt Target #1: | 5'-ACCUCUUUGCUCUCCAAAC-3' | (SEQ ID NO: 4460) |
| CKAP5-6028 19 nt Target #2: | 5'-GACCUCUUUGCUCUCCAAA-3' | (SEQ ID NO: 5036) |
| CKAP5-6028 19 nt Target #3: | 5'-UGACCUCUUUGCUCUCCAA-3' | (SEQ ID NO: 5612) |
| CKAP5-6030 19 nt Target #1: | 5'-CUCUUUGCUCUCCAAACCA-3' | (SEQ ID NO: 4461) |
| CKAP5-6030 19 nt Target #2: | 5'-CCUCUUUGCUCUCCAAACC-3' | (SEQ ID NO: 5037) |
| CKAP5-6030 19 nt Target #3: | 5'-ACCUCUUUGCUCUCCAAAC-3' | (SEQ ID NO: 5613) |
| CKAP5-6032 19 nt Target #1: | 5'-CUUUGCUCUCCAAACCAGC-3' | (SEQ ID NO: 4462) |
| CKAP5-6032 19 nt Target #2: | 5'-UCUUUGCUCUCCAAACCAG-3' | (SEQ ID NO: 5038) |
| CKAP5-6032 19 nt Target #3: | 5'-CUCUUUGCUCUCCAAACCA-3' | (SEQ ID NO: 5614) |
| CKAP5-6173 19 nt Target #1: | 5'-UGACCUCCUCCUCCUCCAC-3' | (SEQ ID NO: 4463) |
| CKAP5-6173 19 nt Target #2: | 5'-GUGACCUCCUCCUCCUCCA-3' | (SEQ ID NO: 5039) |
| CKAP5-6173 19 nt Target #3: | 5'-UGUGACCUCCUCCUCCUCC-3' | (SEQ ID NO: 5615) |
| CKAP5-6217 19 nt Target #1: | 5'-AGACUGGAGAGAAUAAAGA-3' | (SEQ ID NO: 4464) |
| CKAP5-6217 19 nt Target #2: | 5'-AAGACUGGAGAGAAUAAAG-3' | (SEQ ID NO: 5040) |
| CKAP5-6217 19 nt Target #3: | 5'-AAAGACUGGAGAGAAUAAA-3' | (SEQ ID NO: 5616) |
| CKAP5-6219 19 nt Target #1: | 5'-ACUGGAGAGAAUAAAGAGC-3' | (SEQ ID NO: 4465) |
| CKAP5-6219 19 nt Target #2: | 5'-GACUGGAGAGAAUAAAGAG-3' | (SEQ ID NO: 5041) |
| CKAP5-6219 19 nt Target #3: | 5'-AGACUGGAGAGAAUAAAGA-3' | (SEQ ID NO: 5617) |
| CKAP5-6221 19 nt Target #1: | 5'-UGGAGAGAAUAAAGAGCAG-3' | (SEQ ID NO: 4466) |
| CKAP5-6221 19 nt Target #2: | 5'-CUGGAGAGAAUAAAGAGCA-3' | (SEQ ID NO: 5042) |
| CKAP5-6221 19 nt Target #3: | 5'-ACUGGAGAGAAUAAAGAGC-3' | (SEQ ID NO: 5618) |

TABLE 7-continued

DsiRNA Component 19 Nucleotide Target Sequences In CKAP5 mRNA

| | |
|---|---|
| CKAP5-6223 19 nt Target #1: 5'-GAGAGAAUAAAGAGCAGUC-3' | (SEQ ID NO: 4467) |
| CKAP5-6223 19 nt Target #2: 5'-GGAGAGAAUAAAGAGCAGU-3' | (SEQ ID NO: 5043) |
| CKAP5-6223 19 nt Target #3: 5'-UGGAGAGAAUAAAGAGCAG-3' | (SEQ ID NO: 5619) |
| CKAP5-6225 19 nt Target #1: 5'-GAGAAUAAAGAGCAGUCGC-3' | (SEQ ID NO: 4468) |
| CKAP5-6225 19 nt Target #2: 5'-AGAGAAUAAAGAGCAGUCG-3' | (SEQ ID NO: 5044) |
| CKAP5-6225 19 nt Target #3: 5'-GAGAGAAUAAAGAGCAGUC-3' | (SEQ ID NO: 5620) |
| CKAP5-6227 19 nt Target #1: 5'-GAAUAAAGAGCAGUCGCAA-3' | (SEQ ID NO: 4469) |
| CKAP5-6227 19 nt Target #2: 5'-AGAAUAAAGAGCAGUCGCA-3' | (SEQ ID NO: 5045) |
| CKAP5-6227 19 nt Target #3: 5'-GAGAAUAAAGAGCAGUCGC-3' | (SEQ ID NO: 5621) |
| CKAP5-6229 19 nt Target #1: 5'-AUAAAGAGCAGUCGCAAAU-3' | (SEQ ID NO: 4470) |
| CKAP5-6229 19 nt Target #2: 5'-AAUAAAGAGCAGUCGCAAA-3' | (SEQ ID NO: 5046) |
| CKAP5-6229 19 nt Target #3: 5'-GAAUAAAGAGCAGUCGCAA-3' | (SEQ ID NO: 5622) |
| CKAP5-6231 19 nt Target #1: 5'-AAAGAGCAGUCGCAAAUGA-3' | (SEQ ID NO: 4471) |
| CKAP5-6231 19 nt Target #2: 5'-UAAAGAGCAGUCGCAAAUG-3' | (SEQ ID NO: 5047) |
| CKAP5-6231 19 nt Target #3: 5'-AUAAAGAGCAGUCGCAAAU-3' | (SEQ ID NO: 5623) |
| CKAP5-6233 19 nt Target #1: 5'-AGAGCAGUCGCAAAUGAAG-3' | (SEQ ID NO: 4472) |
| CKAP5-6233 19 nt Target #2: 5'-AAGAGCAGUCGCAAAUGAA-3' | (SEQ ID NO: 5048) |
| CKAP5-6233 19 nt Target #3: 5'-AAAGAGCAGUCGCAAAUGA-3' | (SEQ ID NO: 5624) |
| CKAP5-6342 19 nt Target #1: 5'-AAACUGGUUGUAUGUAUCA-3' | (SEQ ID NO: 4473) |
| CKAP5-6342 19 nt Target #2: 5'-CAAACUGGUUGUAUGUAUC-3' | (SEQ ID NO: 5049) |
| CKAP5-6342 19 nt Target #3: 5'-ACAAACUGGUUGUAUGUAU-3' | (SEQ ID NO: 5625) |
| CKAP5-6544 19 nt Target #1: 5'-CUCAUUUGUAAAAUUGUCC-3' | (SEQ ID NO: 4474) |
| CKAP5-6544 19 nt Target #2: 5'-GCUCAUUUGUAAAAUUGUC-3' | (SEQ ID NO: 5050) |
| CKAP5-6544 19 nt Target #3: 5'-UGCUCAUUUGUAAAAUUGU-3' | (SEQ ID NO: 5626) |
| CKAP5-6546 19 nt Target #1: 5'-CAUUUGUAAAAUUGUCCUA-3' | (SEQ ID NO: 4475) |
| CKAP5-6546 19 nt Target #2: 5'-UCAUUUGUAAAAUUGUCCU-3' | (SEQ ID NO: 5051) |
| CKAP5-6546 19 nt Target #3: 5'-CUCAUUUGUAAAAUUGUCC-3' | (SEQ ID NO: 5627) |
| CKAP5-6548 19 nt Target #1: 5'-UUUGUAAAAUUGUCCUAAU-3' | (SEQ ID NO: 4476) |
| CKAP5-6548 19 nt Target #2: 5'-AUUUGUAAAAUUGUCCUAA-3' | (SEQ ID NO: 5052) |
| CKAP5-6548 19 nt Target #3: 5'-CAUUUGUAAAAUUGUCCUA-3' | (SEQ ID NO: 5628) |
| CKAP5-6656 19 nt Target #1: 5'-ACUGUAUUCUGUAUGAAUG-3' | (SEQ ID NO: 4477) |
| CKAP5-6656 19 nt Target #2: 5'-CACUGUAUUCUGUAUGAAU-3' | (SEQ ID NO: 5053) |
| CKAP5-6656 19 nt Target #3: 5'-UCACUGUAUUCUGUAUGAA-3' | (SEQ ID NO: 5629) |
| CKAP5-6658 19 nt Target #1: 5'-UGUAUUCUGUAUGAAUGCA-3' | (SEQ ID NO: 4478) |
| CKAP5-6658 19 nt Target #2: 5'-CUGUAUUCUGUAUGAAUGC-3' | (SEQ ID NO: 5054) |
| CKAP5-6658 19 nt Target #3: 5'-ACUGUAUUCUGUAUGAAUG-3' | (SEQ ID NO: 5630) |
| CKAP5-6660 19 nt Target #1: 5'-UAUUCUGUAUGAAUGCAUG-3' | (SEQ ID NO: 4479) |
| CKAP5-6660 19 nt Target #2: 5'-GUAUUCUGUAUGAAUGCAU-3' | (SEQ ID NO: 5055) |
| CKAP5-6660 19 nt Target #3: 5'-UGUAUUCUGUAUGAAUGCA-3' | (SEQ ID NO: 5631) |

TABLE 7-continued

DsiRNA Component 19 Nucleotide Target Sequences In CKAP5 mRNA

| | | |
|---|---|---|
| CKAP5-6662 19 nt Target #1: | 5'-UUCUGUAUGAAUGCAUGGC-3' | (SEQ ID NO: 4480) |
| CKAP5-6662 19 nt Target #2: | 5'-AUUCUGUAUGAAUGCAUGG-3' | (SEQ ID NO: 5056) |
| CKAP5-6662 19 nt Target #3: | 5'-UAUUCUGUAUGAAUGCAUG-3' | (SEQ ID NO: 5632) |
| CKAP5-6664 19 nt Target #1: | 5'-CUGUAUGAAUGCAUGGCAU-3' | (SEQ ID NO: 4481) |
| CKAP5-6664 19 nt Target #2: | 5'-UCUGUAUGAAUGCAUGGCA-3' | (SEQ ID NO: 5057) |
| CKAP5-6664 19 nt Target #3: | 5'-UUCUGUAUGAAUGCAUGGC-3' | (SEQ ID NO: 5633) |
| CKAP5-6666 19 nt Target #1: | 5'-GUAUGAAUGCAUGGCAUGA-3' | (SEQ ID NO: 4482) |
| CKAP5-6666 19 nt Target #2: | 5'-UGUAUGAAUGCAUGGCAUG-3' | (SEQ ID NO: 5058) |
| CKAP5-6666 19 nt Target #3: | 5'-CUGUAUGAAUGCAUGGCAU-3' | (SEQ ID NO: 5634) |
| CKAP5-6704 19 nt Target #1: | 5'-UUUUAUAAAUAAAGUUUGC-3' | (SEQ ID NO: 4483) |
| CKAP5-6704 19 nt Target #2: | 5'-CUUUUAUAAAUAAAGUUUG-3' | (SEQ ID NO: 5059) |
| CKAP5-6704 19 nt Target #3: | 5'-UCUUUUAUAAAUAAAGUUU-3' | (SEQ ID NO: 5635) |
| CKAP5-6706 19 nt Target #1: | 5'-UUAUAAAUAAAGUUUGCAU-3' | (SEQ ID NO: 4484) |
| CKAP5-6706 19 nt Target #2: | 5'-UUUAUAAAUAAAGUUUGCA-3' | (SEQ ID NO: 5060) |
| CKAP5-6706 19 nt Target #3: | 5'-UUUUAUAAAUAAAGUUUGC-3' | (SEQ ID NO: 5636) |
| CKAP5-6708 19 nt Target #1: | 5'-AUAAAUAAAGUUUGCAUUA-3' | (SEQ ID NO: 4485) |
| CKAP5-6708 19 nt Target #2: | 5'-UAUAAAUAAAGUUUGCAUU-3' | (SEQ ID NO: 5061) |
| CKAP5-6708 19 nt Target #3: | 5'-UUAUAAAUAAAGUUUGCAU-3' | (SEQ ID NO: 5637) |
| CKAP5-6710 19 nt Target #1: | 5'-AAAUAAAGUUUGCAUUAAC-3' | (SEQ ID NO: 4486) |
| CKAP5-6710 19 nt Target #2: | 5'-UAAAUAAAGUUUGCAUUAA-3' | (SEQ ID NO: 5062) |
| CKAP5-6710 19 nt Target #3: | 5'-AUAAAUAAAGUUUGCAUUA-3' | (SEQ ID NO: 5638) |
| CKAP5-6712 19 nt Target #1: | 5'-AUAAAGUUUGCAUUAACUA-3' | (SEQ ID NO: 4487) |
| CKAP5-6712 19 nt Target #2: | 5'-AAUAAAGUUUGCAUUAACU-3' | (SEQ ID NO: 5063) |
| CKAP5-6712 19 nt Target #3: | 5'-AAAUAAAGUUUGCAUUAAC-3' | (SEQ ID NO: 5639) |
| CKAP5-6714 19 nt Target #1: | 5'-AAAGUUUGCAUUAACUAUA-3' | (SEQ ID NO: 4488) |
| CKAP5-6714 19 nt Target #2: | 5'-UAAAGUUUGCAUUAACUAU-3' | (SEQ ID NO: 5064) |
| CKAP5-6714 19 nt Target #3: | 5'-AUAAAGUUUGCAUUAACUA-3' | (SEQ ID NO: 5640) |
| CKAP5-106 19 nt Target #1: | 5'-CAGCUGAGGAAAUACUCUU-3' | (SEQ ID NO: 4489) |
| CKAP5-106 19 nt Target #2: | 5'-CCAGCUGAGGAAAUACUCU-3' | (SEQ ID NO: 5065) |
| CKAP5-106 19 nt Target #3: | 5'-CCCAGCUGAGGAAAUACUC-3' | (SEQ ID NO: 5641) |
| CKAP5-172 19 nt Target #1: | 5'-UUGAAACUGCCAGUUGAUC-3' | (SEQ ID NO: 4490) |
| CKAP5-172 19 nt Target #2: | 5'-GUUGAAACUGCCAGUUGAU-3' | (SEQ ID NO: 5066) |
| CKAP5-172 19 nt Target #3: | 5'-GGUUGAAACUGCCAGUUGA-3' | (SEQ ID NO: 5642) |
| CKAP5-180 19 nt Target #1: | 5'-GCCAGUUGAUCAGAAAUGU-3' | (SEQ ID NO: 4491) |
| CKAP5-180 19 nt Target #2: | 5'-UGCCAGUUGAUCAGAAAUG-3' | (SEQ ID NO: 5067) |
| CKAP5-180 19 nt Target #3: | 5'-CUGCCAGUUGAUCAGAAAU-3' | (SEQ ID NO: 5643) |
| CKAP5-213 19 nt Target #1: | 5'-GAAAGCAAGGUUAAGUGGG-3' | (SEQ ID NO: 4492) |
| CKAP5-213 19 nt Target #2: | 5'-GGAAAGCAAGGUUAAGUGG-3' | (SEQ ID NO: 5068) |
| CKAP5-213 19 nt Target #3: | 5'-UGGAAAGCAAGGUUAAGUG-3' | (SEQ ID NO: 5644) |

TABLE 7-continued

DsiRNA Component 19 Nucleotide Target Sequences In CKAP5 mRNA

| | | |
|---|---|---|
| CKAP5-281 19 nt Target #1: | 5'-CAGAGUGGUCCAAAUUUUU-3' | (SEQ ID NO: 4493) |
| CKAP5-281 19 nt Target #2: | 5'-CCAGAGUGGUCCAAAUUUU-3' | (SEQ ID NO: 5069) |
| CKAP5-281 19 nt Target #3: | 5'-CCCAGAGUGGUCCAAAUUU-3' | (SEQ ID NO: 5645) |
| CKAP5-337 19 nt Target #1: | 5'-GUGGUUCAAUUGAAAGGAU-3' | (SEQ ID NO: 4494) |
| CKAP5-337 19 nt Target #2: | 5'-AGUGGUUCAAUUGAAAGGA-3' | (SEQ ID NO: 5070) |
| CKAP5-337 19 nt Target #3: | 5'-CAGUGGUUCAAUUGAAAGG-3' | (SEQ ID NO: 5646) |
| CKAP5-353 19 nt Target #1: | 5'-GAUUAGAAGCUGCACUUGU-3' | (SEQ ID NO: 4495) |
| CKAP5-353 19 nt Target #2: | 5'-GGAUUAGAAGCUGCACUUG-3' | (SEQ ID NO: 5071) |
| CKAP5-353 19 nt Target #3: | 5'-AGGAUUAGAAGCUGCACUU-3' | (SEQ ID NO: 5647) |
| CKAP5-362 19 nt Target #1: | 5'-CUGCACUUGUUUAUGUUGA-3' | (SEQ ID NO: 4496) |
| CKAP5-362 19 nt Target #2: | 5'-GCUGCACUUGUUUAUGUUG-3' | (SEQ ID NO: 5072) |
| CKAP5-362 19 nt Target #3: | 5'-AGCUGCACUUGUUUAUGUU-3' | (SEQ ID NO: 5648) |
| CKAP5-395 19 nt Target #1: | 5'-CAGGAAAAACCACAGGAGA-3' | (SEQ ID NO: 4497) |
| CKAP5-395 19 nt Target #2: | 5'-GCAGGAAAAACCACAGGAG-3' | (SEQ ID NO: 5073) |
| CKAP5-395 19 nt Target #3: | 5'-AGCAGGAAAAACCACAGGA-3' | (SEQ ID NO: 5649) |
| CKAP5-422 19 nt Target #1: | 5'-CAGGUGUUGUAAGUAAGGU-3' | (SEQ ID NO: 4498) |
| CKAP5-422 19 nt Target #2: | 5'-UCAGGUGUUGUAAGUAAGG-3' | (SEQ ID NO: 5074) |
| CKAP5-422 19 nt Target #3: | 5'-GUCAGGUGUUGUAAGUAAG-3' | (SEQ ID NO: 5650) |
| CKAP5-427 19 nt Target #1: | 5'-GUUGUAAGUAAGGUGUUCA-3' | (SEQ ID NO: 4499) |
| CKAP5-427 19 nt Target #2: | 5'-UGUUGUAAGUAAGGUGUUC-3' | (SEQ ID NO: 5075) |
| CKAP5-427 19 nt Target #3: | 5'-GUGUUGUAAGUAAGGUGUU-3' | (SEQ ID NO: 5651) |
| CKAP5-443 19 nt Target #1: | 5'-UCAAUCAACCUAAAGCUAA-3' | (SEQ ID NO: 4500) |
| CKAP5-443 19 nt Target #2: | 5'-UUCAAUCAACCUAAAGCUA-3' | (SEQ ID NO: 5076) |
| CKAP5-443 19 nt Target #3: | 5'-GUUCAAUCAACCUAAAGCU-3' | (SEQ ID NO: 5652) |
| CKAP5-537 19 nt Target #1: | 5'-CCUGAAAGGCUUGGACAAU-3' | (SEQ ID NO: 4501) |
| CKAP5-537 19 nt Target #2: | 5'-UCCUGAAAGGCUUGGACAA-3' | (SEQ ID NO: 5077) |
| CKAP5-537 19 nt Target #3: | 5'-CUCCUGAAAGGCUUGGACA-3' | (SEQ ID NO: 5653) |
| CKAP5-637 19 nt Target #1: | 5'-AAGCCAAUUAUCAAAGUGU-3' | (SEQ ID NO: 4502) |
| CKAP5-637 19 nt Target #2: | 5'-UAAGCCAAUUAUCAAAGUG-3' | (SEQ ID NO: 5078) |
| CKAP5-637 19 nt Target #3: | 5'-UUAAGCCAAUUAUCAAAGU-3' | (SEQ ID NO: 5654) |
| CKAP5-649 19 nt Target #1: | 5'-AAAGUGUUGCCAAAACUCU-3' | (SEQ ID NO: 4503) |
| CKAP5-649 19 nt Target #2: | 5'-CAAAGUGUUGCCAAAACUC-3' | (SEQ ID NO: 5079) |
| CKAP5-649 19 nt Target #3: | 5'-UCAAAGUGUUGCCAAAACU-3' | (SEQ ID NO: 5655) |
| CKAP5-659 19 nt Target #1: | 5'-CAAAACUCUUUGAGUCUCG-3' | (SEQ ID NO: 4504) |
| CKAP5-659 19 nt Target #2: | 5'-CCAAAACUCUUUGAGUCUC-3' | (SEQ ID NO: 5080) |
| CKAP5-659 19 nt Target #3: | 5'-GCCAAAACUCUUUGAGUCU-3' | (SEQ ID NO: 5656) |
| CKAP5-686 19 nt Target #1: | 5'-CUGUUCGAGAUGAAGCCAA-3' | (SEQ ID NO: 4505) |
| CKAP5-686 19 nt Target #2: | 5'-GCUGUUCGAGAUGAAGCCA-3' | (SEQ ID NO: 5081) |
| CKAP5-686 19 nt Target #3: | 5'-GGCUGUUCGAGAUGAAGCC-3' | (SEQ ID NO: 5657) |

TABLE 7-continued

DsiRNA Component 19 Nucleotide Target Sequences In CKAP5 mRNA

| | | |
|---|---|---|
| CKAP5-755 19 nt Target #1: | 5'-CAUUACAAAAUAUAAACUC-3' | (SEQ ID NO: 4506) |
| CKAP5-755 19 nt Target #2: | 5'-CCAUUACAAAAUAUAAACU-3' | (SEQ ID NO: 5082) |
| CKAP5-755 19 nt Target #3: | 5'-CCCAUUACAAAAUAUAAAC-3' | (SEQ ID NO: 5658) |
| CKAP5-761 19 nt Target #1: | 5'-AAAAUAUAAACUCUGUUCA-3' | (SEQ ID NO: 4507) |
| CKAP5-761 19 nt Target #2: | 5'-CAAAAUAUAAACUCUGUUC-3' | (SEQ ID NO: 5083) |
| CKAP5-761 19 nt Target #3: | 5'-ACAAAAUAUAAACUCUGUU-3' | (SEQ ID NO: 5659) |
| CKAP5-766 19 nt Target #1: | 5'-AUAAACUCUGUUCAGUUGA-3' | (SEQ ID NO: 4508) |
| CKAP5-766 19 nt Target #2: | 5'-UAUAAACUCUGUUCAGUUG-3' | (SEQ ID NO: 5084) |
| CKAP5-766 19 nt Target #3: | 5'-AUAUAAACUCUGUUCAGUU-3' | (SEQ ID NO: 5660) |
| CKAP5-773 19 nt Target #1: | 5'-CUGUUCAGUUGAAAGAACU-3' | (SEQ ID NO: 4509) |
| CKAP5-773 19 nt Target #2: | 5'-UCUGUUCAGUUGAAAGAAC-3' | (SEQ ID NO: 5085) |
| CKAP5-773 19 nt Target #3: | 5'-CUCUGUUCAGUUGAAAGAA-3' | (SEQ ID NO: 5661) |
| CKAP5-928 19 nt Target #1: | 5'-GAUGAGGUGCCACAAAUAG-3' | (SEQ ID NO: 4510) |
| CKAP5-928 19 nt Target #2: | 5'-UGAUGAGGUGCCACAAAUA-3' | (SEQ ID NO: 5086) |
| CKAP5-928 19 nt Target #3: | 5'-GUGAUGAGGUGCCACAAAU-3' | (SEQ ID NO: 5662) |
| CKAP5-941 19 nt Target #1: | 5'-AAAUAGAUGCUUAUGAGCU-3' | (SEQ ID NO: 4511) |
| CKAP5-941 19 nt Target #2: | 5'-CAAAUAGAUGCUUAUGAGC-3' | (SEQ ID NO: 5087) |
| CKAP5-941 19 nt Target #3: | 5'-ACAAAUAGAUGCUUAUGAG-3' | (SEQ ID NO: 5663) |
| CKAP5-953 19 nt Target #1: | 5'-AUGAGCUUUUAGAAGCUGU-3' | (SEQ ID NO: 4512) |
| CKAP5-953 19 nt Target #2: | 5'-UAUGAGCUUUUAGAAGCUG-3' | (SEQ ID NO: 5088) |
| CKAP5-953 19 nt Target #3: | 5'-UUAUGAGCUUUUAGAAGCU-3' | (SEQ ID NO: 5664) |
| CKAP5-1046 19 nt Target #1: | 5'-CCCUGGAGUCUGUAGAAGU-3' | (SEQ ID NO: 4513) |
| CKAP5-1046 19 nt Target #2: | 5'-GCCCUGGAGUCUGUAGAAG-3' | (SEQ ID NO: 5089) |
| CKAP5-1046 19 nt Target #3: | 5'-GGCCCUGGAGUCUGUAGAA-3' | (SEQ ID NO: 5665) |
| CKAP5-1051 19 nt Target #1: | 5'-GAGUCUGUAGAAGUACUAA-3' | (SEQ ID NO: 4514) |
| CKAP5-1051 19 nt Target #2: | 5'-GGAGUCUGUAGAAGUACUA-3' | (SEQ ID NO: 5090) |
| CKAP5-1051 19 nt Target #3: | 5'-UGGAGUCUGUAGAAGUACU-3' | (SEQ ID NO: 5666) |
| CKAP5-1103 19 nt Target #1: | 5'-CAGAUUUAGUAAAAGCAUU-3' | (SEQ ID NO: 4515) |
| CKAP5-1103 19 nt Target #2: | 5'-GCAGAUUUAGUAAAAGCAU-3' | (SEQ ID NO: 5091) |
| CKAP5-1103 19 nt Target #3: | 5'-UGCAGAUUUAGUAAAAGCA-3' | (SEQ ID NO: 5667) |
| CKAP5-1113 19 nt Target #1: | 5'-AAAAGCAUUAAAGAAGGUU-3' | (SEQ ID NO: 4516) |
| CKAP5-1113 19 nt Target #2: | 5'-UAAAAGCAUUAAAGAAGGU-3' | (SEQ ID NO: 5092) |
| CKAP5-1113 19 nt Target #3: | 5'-GUAAAAGCAUUAAAGAAGG-3' | (SEQ ID NO: 5668) |
| CKAP5-1118 19 nt Target #1: | 5'-CAUUAAAGAAGGUUGUUGG-3' | (SEQ ID NO: 4517) |
| CKAP5-1118 19 nt Target #2: | 5'-GCAUUAAAGAAGGUUGUUG-3' | (SEQ ID NO: 5093) |
| CKAP5-1118 19 nt Target #3: | 5'-AGCAUUAAAGAAGGUUGUU-3' | (SEQ ID NO: 5669) |
| CKAP5-1125 19 nt Target #1: | 5'-GAAGGUUGUUGGAAAGGAC-3' | (SEQ ID NO: 4518) |
| CKAP5-1125 19 nt Target #2: | 5'-AGAAGGUUGUUGGAAAGGA-3' | (SEQ ID NO: 5094) |
| CKAP5-1125 19 nt Target #3: | 5'-AAGAAGGUUGUUGGAAAGG-3' | (SEQ ID NO: 5670) |

TABLE 7-continued

DsiRNA Component 19 Nucleotide Target Sequences In CKAP5 mRNA

| | | |
|---|---|---|
| CKAP5-1205 19 nt Target #1: | 5'-GGAAGAAAUUUGGACAAUA-3' | (SEQ ID NO: 4519) |
| CKAP5-1205 19 nt Target #2: | 5'-AGGAAGAAAUUUGGACAAU-3' | (SEQ ID NO: 5095) |
| CKAP5-1205 19 nt Target #3: | 5'-AAGGAAGAAAUUUGGACAA-3' | (SEQ ID NO: 5671) |
| CKAP5-1343 19 nt Target #1: | 5'-GUGAGGAUGUUUUAGCAGU-3' | (SEQ ID NO: 4520) |
| CKAP5-1343 19 nt Target #2: | 5'-AGUGAGGAUGUUUUAGCAG-3' | (SEQ ID NO: 5096) |
| CKAP5-1343 19 nt Target #3: | 5'-CAGUGAGGAUGUUUUAGCA-3' | (SEQ ID NO: 5672) |
| CKAP5-1351 19 nt Target #1: | 5'-GUUUUAGCAGUAAUGGAUA-3' | (SEQ ID NO: 4521) |
| CKAP5-1351 19 nt Target #2: | 5'-UGUUUUAGCAGUAAUGGAU-3' | (SEQ ID NO: 5097) |
| CKAP5-1351 19 nt Target #3: | 5'-AUGUUUUAGCAGUAAUGGA-3' | (SEQ ID NO: 5673) |
| CKAP5-1386 19 nt Target #1: | 5'-CAAGCAGCAGACAUCUCUU-3' | (SEQ ID NO: 4522) |
| CKAP5-1386 19 nt Target #2: | 5'-UCAAGCAGCAGACAUCUCU-3' | (SEQ ID NO: 5098) |
| CKAP5-1386 19 nt Target #3: | 5'-AUCAAGCAGCAGACAUCUC-3' | (SEQ ID NO: 5674) |
| CKAP5-1395 19 nt Target #1: | 5'-GACAUCUCUUUUUAUUGCA-3' | (SEQ ID NO: 4523) |
| CKAP5-1395 19 nt Target #2: | 5'-AGACAUCUCUUUUUAUUGC-3' | (SEQ ID NO: 5099) |
| CKAP5-1395 19 nt Target #3: | 5'-CAGACAUCUCUUUUUAUUG-3' | (SEQ ID NO: 5675) |
| CKAP5-1514 19 nt Target #1: | 5'-UCAGAGAUGCCGCAUUUGA-3' | (SEQ ID NO: 4524) |
| CKAP5-1514 19 nt Target #2: | 5'-GUCAGAGAUGCCGCAUUUG-3' | (SEQ ID NO: 5100) |
| CKAP5-1514 19 nt Target #3: | 5'-AGUCAGAGAUGCCGCAUUU-3' | (SEQ ID NO: 5676) |
| CKAP5-1535 19 nt Target #1: | 5'-CAUUGGGUACUGCUUUGAA-3' | (SEQ ID NO: 4525) |
| CKAP5-1535 19 nt Target #2: | 5'-GCAUUGGGUACUGCUUUGA-3' | (SEQ ID NO: 5101) |
| CKAP5-1535 19 nt Target #3: | 5'-AGCAUUGGGUACUGCUUUG-3' | (SEQ ID NO: 5677) |
| CKAP5-1594 19 nt Target #1: | 5'-GUGGACAAACUCAAGCUUG-3' | (SEQ ID NO: 4526) |
| CKAP5-1594 19 nt Target #2: | 5'-UGUGGACAAACUCAAGCUU-3' | (SEQ ID NO: 5102) |
| CKAP5-1594 19 nt Target #3: | 5'-AUGUGGACAAACUCAAGCU-3' | (SEQ ID NO: 5678) |
| CKAP5-1622 19 nt Target #1: | 5'-AAGAAUGUUCAGAAAGGU-3' | (SEQ ID NO: 4527) |
| CKAP5-1622 19 nt Target #2: | 5'-AAAGAAUGUUCAGAAAGG-3' | (SEQ ID NO: 5103) |
| CKAP5-1622 19 nt Target #3: | 5'-CAAAGAAUGUUCAGAAAG-3' | (SEQ ID NO: 5679) |
| CKAP5-1630 19 nt Target #1: | 5'-UCAGAAAAGGUAGAACUGA-3' | (SEQ ID NO: 4528) |
| CKAP5-1630 19 nt Target #2: | 5'-UUCAGAAAAGGUAGAACUG-3' | (SEQ ID NO: 5104) |
| CKAP5-1630 19 nt Target #3: | 5'-GUUCAGAAAAGGUAGAACU-3' | (SEQ ID NO: 5680) |
| CKAP5-1638 19 nt Target #1: | 5'-GGUAGAACUGAUACAUGGU-3' | (SEQ ID NO: 4529) |
| CKAP5-1638 19 nt Target #2: | 5'-AGGUAGAACUGAUACAUGG-3' | (SEQ ID NO: 5105) |
| CKAP5-1638 19 nt Target #3: | 5'-AAGGUAGAACUGAUACAUG-3' | (SEQ ID NO: 5681) |
| CKAP5-1847 19 nt Target #1: | 5'-CAGGGAAUACUGGAACCAA-3' | (SEQ ID NO: 4530) |
| CKAP5-1847 19 nt Target #2: | 5'-GCAGGGAAUACUGGAACCA-3' | (SEQ ID NO: 5106) |
| CKAP5-1847 19 nt Target #3: | 5'-CGCAGGGAAUACUGGAACC-3' | (SEQ ID NO: 5682) |
| CKAP5-1903 19 nt Target #1: | 5'-CCUGAGCUCUCGAUAGAAG-3' | (SEQ ID NO: 4531) |
| CKAP5-1903 19 nt Target #2: | 5'-GCCUGAGCUCUCGAUAGAA-3' | (SEQ ID NO: 5107) |
| CKAP5-1903 19 nt Target #3: | 5'-AGCCUGAGCUCUCGAUAGA-3' | (SEQ ID NO: 5683) |

TABLE 7-continued

DsiRNA Component 19 Nucleotide Target Sequences In CKAP5 mRNA

| | | |
|---|---|---|
| CKAP5-1913 19 nt Target #1: | 5'-CGAUAGAAGUAUGUGAAGA-3' | (SEQ ID NO: 4532) |
| CKAP5-1913 19 nt Target #2: | 5'-UCGAUAGAAGUAUGUGAAG-3' | (SEQ ID NO: 5108) |
| CKAP5-1913 19 nt Target #3: | 5'-CUCGAUAGAAGUAUGUGAA-3' | (SEQ ID NO: 5684) |
| CKAP5-1972 19 nt Target #1: | 5'-CUUGACAGCAGUAACUGGA-3' | (SEQ ID NO: 4533) |
| CKAP5-1972 19 nt Target #2: | 5'-UCUUGACAGCAGUAACUGG-3' | (SEQ ID NO: 5109) |
| CKAP5-1972 19 nt Target #3: | 5'-UUCUUGACAGCAGUAACUG-3' | (SEQ ID NO: 5685) |
| CKAP5-2034 19 nt Target #1: | 5'-GCUAAUGGACCGAACUGAA-3' | (SEQ ID NO: 4534) |
| CKAP5-2034 19 nt Target #2: | 5'-AGCUAAUGGACCGAACUGA-3' | (SEQ ID NO: 5110) |
| CKAP5-2034 19 nt Target #3: | 5'-GAGCUAAUGGACCGAACUG-3' | (SEQ ID NO: 5686) |
| CKAP5-2068 19 nt Target #1: | 5'-UUAGUGAGGAUGCUAGCCA-3' | (SEQ ID NO: 4535) |
| CKAP5-2068 19 nt Target #2: | 5'-AUUAGUGAGGAUGCUAGCC-3' | (SEQ ID NO: 5111) |
| CKAP5-2068 19 nt Target #3: | 5'-CAUUAGUGAGGAUGCUAGC-3' | (SEQ ID NO: 5687) |
| CKAP5-2083 19 nt Target #1: | 5'-GCCAAGAAACCUGGAUGGA-3' | (SEQ ID NO: 4536) |
| CKAP5-2083 19 nt Target #2: | 5'-AGCCAAGAAACCUGGAUGG-3' | (SEQ ID NO: 5112) |
| CKAP5-2083 19 nt Target #3: | 5'-UAGCCAAGAAACCUGGAUG-3' | (SEQ ID NO: 5688) |
| CKAP5-2088 19 nt Target #1: | 5'-GAAACCUGGAUGGAAAGAA-3' | (SEQ ID NO: 4537) |
| CKAP5-2088 19 nt Target #2: | 5'-AGAAACCUGGAUGGAAAGA-3' | (SEQ ID NO: 5113) |
| CKAP5-2088 19 nt Target #3: | 5'-AAGAAACCUGGAUGGAAAG-3' | (SEQ ID NO: 5689) |
| CKAP5-2119 19 nt Target #1: | 5'-GUGAUGCAAAUGAAGCUUC-3' | (SEQ ID NO: 4538) |
| CKAP5-2119 19 nt Target #2: | 5'-GGUGAUGCAAAUGAAGCUU-3' | (SEQ ID NO: 5114) |
| CKAP5-2119 19 nt Target #3: | 5'-AGGUGAUGCAAAUGAAGCU-3' | (SEQ ID NO: 5690) |
| CKAP5-2177 19 nt Target #1: | 5'-AAACGUCAGCUCAGGUUGU-3' | (SEQ ID NO: 4539) |
| CKAP5-2177 19 nt Target #2: | 5'-AAAACGUCAGCUCAGGUUG-3' | (SEQ ID NO: 5115) |
| CKAP5-2177 19 nt Target #3: | 5'-CAAAACGUCAGCUCAGGUU-3' | (SEQ ID NO: 5691) |
| CKAP5-2246 19 nt Target #1: | 5'-CAAAGAAGCUAUGACAGC-3' | (SEQ ID NO: 4540) |
| CKAP5-2246 19 nt Target #2: | 5'-GCAAAAGAAGCUAUGACAG-3' | (SEQ ID NO: 5116) |
| CKAP5-2246 19 nt Target #3: | 5'-UGCAAAAGAAGCUAUGACA-3' | (SEQ ID NO: 5692) |
| CKAP5-2261 19 nt Target #1: | 5'-CAGCAAUAGCCGAAGCCUG-3' | (SEQ ID NO: 4541) |
| CKAP5-2261 19 nt Target #2: | 5'-ACAGCAAUAGCCGAAGCCU-3' | (SEQ ID NO: 5117) |
| CKAP5-2261 19 nt Target #3: | 5'-GACAGCAAUAGCCGAAGCC-3' | (SEQ ID NO: 5693) |
| CKAP5-2272 19 nt Target #1: | 5'-GAAGCCUGUAUGUUACCAU-3' | (SEQ ID NO: 4542) |
| CKAP5-2272 19 nt Target #2: | 5'-CGAAGCCUGUAUGUUACCA-3' | (SEQ ID NO: 5118) |
| CKAP5-2272 19 nt Target #3: | 5'-CCGAAGCCUGUAUGUUACC-3' | (SEQ ID NO: 5694) |
| CKAP5-2339 19 nt Target #1: | 5'-AAAAUCAGUCAGAAACUCU-3' | (SEQ ID NO: 4543) |
| CKAP5-2339 19 nt Target #2: | 5'-AAAAAUCAGUCAGAAACUC-3' | (SEQ ID NO: 5119) |
| CKAP5-2339 19 nt Target #3: | 5'-CAAAAAUCAGUCAGAAACU-3' | (SEQ ID NO: 5695) |
| CKAP5-2412 19 nt Target #1: | 5'-AGCUUUCAUUAGCAAUGUG-3' | (SEQ ID NO: 4544) |
| CKAP5-2412 19 nt Target #2: | 5'-AAGCUUUCAUUAGCAAUGU-3' | (SEQ ID NO: 5120) |
| CKAP5-2412 19 nt Target #3: | 5'-AAAGCUUUCAUUAGCAAUG-3' | (SEQ ID NO: 5696) |

TABLE 7-continued

DsiRNA Component 19 Nucleotide Target Sequences In CKAP5 mRNA

```
CKAP5-2578 19 nt Target #1:   5'-GAGAAGAUGCAGGGACAAA-3'   (SEQ ID NO: 4545)

CKAP5-2578 19 nt Target #2:   5'-UGAGAAGAUGCAGGGACAA-3'   (SEQ ID NO: 5121)

CKAP5-2578 19 nt Target #3:   5'-UUGAGAAGAUGCAGGGACA-3'   (SEQ ID NO: 5697)

CKAP5-2684 19 nt Target #1:   5'-GCAAUGAUGUCGUUGAUCU-3'   (SEQ ID NO: 4546)

CKAP5-2684 19 nt Target #2:   5'-AGCAAUGAUGUCGUUGAUC-3'   (SEQ ID NO: 5122)

CKAP5-2684 19 nt Target #3:   5'-GAGCAAUGAUGUCGUUGAU-3'   (SEQ ID NO: 5698)

CKAP5-2797 19 nt Target #1:   5'-GAAGUGGCAGGUAUUAUUA-3'   (SEQ ID NO: 4547)

CKAP5-2797 19 nt Target #2:   5'-UGAAGUGGCAGGUAUUAUU-3'   (SEQ ID NO: 5123)

CKAP5-2797 19 nt Target #3:   5'-AUGAAGUGGCAGGUAUUAU-3'   (SEQ ID NO: 5699)

CKAP5-2860 19 nt Target #1:   5'-GCCUUGAAGGGUCGACUCA-3'   (SEQ ID NO: 4548)

CKAP5-2860 19 nt Target #2:   5'-UGCCUUGAAGGGUCGACUC-3'   (SEQ ID NO: 5124)

CKAP5-2860 19 nt Target #3:   5'-CUGCCUUGAAGGGUCGACU-3'   (SEQ ID NO: 5700)

CKAP5-2865 19 nt Target #1:   5'-GAAGGGUCGACUCAAUGAU-3'   (SEQ ID NO: 4549)

CKAP5-2865 19 nt Target #2:   5'-UGAAGGGUCGACUCAAUGA-3'   (SEQ ID NO: 5125)

CKAP5-2865 19 nt Target #3:   5'-UUGAAGGGUCGACUCAAUG-3'   (SEQ ID NO: 5701)

CKAP5-2873 19 nt Target #1:   5'-GACUCAAUGAUUCAAAUAA-3'   (SEQ ID NO: 4550)

CKAP5-2873 19 nt Target #2:   5'-CGACUCAAUGAUUCAAAUA-3'   (SEQ ID NO: 5126)

CKAP5-2873 19 nt Target #3:   5'-UCGACUCAAUGAUUCAAAU-3'   (SEQ ID NO: 5702)

CKAP5-2879 19 nt Target #1:   5'-AUGAUUCAAAUAAAAUCUU-3'   (SEQ ID NO: 4551)

CKAP5-2879 19 nt Target #2:   5'-AAUGAUUCAAAUAAAAUCU-3'   (SEQ ID NO: 5127)

CKAP5-2879 19 nt Target #3:   5'-CAAUGAUUCAAAUAAAAUC-3'   (SEQ ID NO: 5703)

CKAP5-2937 19 nt Target #1:   5'-AGCCAUGGGCCCAAAUAUU-3'   (SEQ ID NO: 4552)

CKAP5-2937 19 nt Target #2:   5'-UAGCCAUGGGCCCAAAUAU-3'   (SEQ ID NO: 5128)

CKAP5-2937 19 nt Target #3:   5'-GUAGCCAUGGGCCCAAAUA-3'   (SEQ ID NO: 5704)

CKAP5-2949 19 nt Target #1:   5'-AAAUAUUAAGCAACAUGUA-3'   (SEQ ID NO: 4553)

CKAP5-2949 19 nt Target #2:   5'-CAAAUAUUAAGCAACAUGU-3'   (SEQ ID NO: 5129)

CKAP5-2949 19 nt Target #3:   5'-CCAAAUAUUAAGCAACAUG-3'   (SEQ ID NO: 5705)

CKAP5-2997 19 nt Target #1:   5'-CCUUGGAGACAGCAAGAAC-3'   (SEQ ID NO: 4554)

CKAP5-2997 19 nt Target #2:   5'-UCCUUGGAGACAGCAAGAA-3'   (SEQ ID NO: 5130)

CKAP5-2997 19 nt Target #3:   5'-GUCCUUGGAGACAGCAAGA-3'   (SEQ ID NO: 5706)

CKAP5-3002 19 nt Target #1:   5'-GAGACAGCAAGAACAAUGU-3'   (SEQ ID NO: 4555)

CKAP5-3002 19 nt Target #2:   5'-GGAGACAGCAAGAACAAUG-3'   (SEQ ID NO: 5131)

CKAP5-3002 19 nt Target #3:   5'-UGGAGACAGCAAGAACAAU-3'   (SEQ ID NO: 5707)

CKAP5-3285 19 nt Target #1:   5'-CAUGAUGCAUUUAGGAUAU-3'   (SEQ ID NO: 4556)

CKAP5-3285 19 nt Target #2:   5'-UCAUGAUGCAUUUAGGAUA-3'   (SEQ ID NO: 5132)

CKAP5-3285 19 nt Target #3:   5'-UUCAUGAUGCAUUUAGGAU-3'   (SEQ ID NO: 5708)

CKAP5-3367 19 nt Target #1:   5'-CUAGAGAAAGCCAAAGUUA-3'   (SEQ ID NO: 4557)

CKAP5-3367 19 nt Target #2:   5'-GCUAGAGAAAGCCAAAGUU-3'   (SEQ ID NO: 5133)

CKAP5-3367 19 nt Target #3:   5'-UGCUAGAGAAAGCCAAAGU-3'   (SEQ ID NO: 5709)
```

TABLE 7-continued

DsiRNA Component 19 Nucleotide Target Sequences In CKAP5 mRNA

| | | |
|---|---|---|
| CKAP5-3571 19 nt Target #1: | 5'-GGGAAGAAGAUGCCAAGCA-3' | (SEQ ID NO: 4558) |
| CKAP5-3571 19 nt Target #2: | 5'-AGGGAAGAAGAUGCCAAGC-3' | (SEQ ID NO: 5134) |
| CKAP5-3571 19 nt Target #3: | 5'-AAGGGAAGAAGAUGCCAAG-3' | (SEQ ID NO: 5710) |
| CKAP5-3650 19 nt Target #1: | 5'-GAAAAGAGCAAAGGAUGAA-3' | (SEQ ID NO: 4559) |
| CKAP5-3650 19 nt Target #2: | 5'-GGAAAAGAGCAAAGGAUGA-3' | (SEQ ID NO: 5135) |
| CKAP5-3650 19 nt Target #3: | 5'-UGGAAAAGAGCAAAGGAUG-3' | (SEQ ID NO: 5711) |
| CKAP5-3655 19 nt Target #1: | 5'-GAGCAAAGGAUGAAAGAUG-3' | (SEQ ID NO: 4560) |
| CKAP5-3655 19 nt Target #2: | 5'-AGAGCAAAGGAUGAAAGAU-3' | (SEQ ID NO: 5136) |
| CKAP5-3655 19 nt Target #3: | 5'-AAGAGCAAAGGAUGAAAGA-3' | (SEQ ID NO: 5712) |
| CKAP5-3716 19 nt Target #1: | 5'-GGGAUGAAUACAUUGAGCA-3' | (SEQ ID NO: 4561) |
| CKAP5-3716 19 nt Target #2: | 5'-CGGGAUGAAUACAUUGAGC-3' | (SEQ ID NO: 5137) |
| CKAP5-3716 19 nt Target #3: | 5'-ACGGGAUGAAUACAUUGAG-3' | (SEQ ID NO: 5713) |
| CKAP5-3721 19 nt Target #1: | 5'-GAAUACAUUGAGCAACUAA-3' | (SEQ ID NO: 4562) |
| CKAP5-3721 19 nt Target #2: | 5'-UGAAUACAUUGAGCAACUA-3' | (SEQ ID NO: 5138) |
| CKAP5-3721 19 nt Target #3: | 5'-AUGAAUACAUUGAGCAACU-3' | (SEQ ID NO: 5714) |
| CKAP5-3890 19 nt Target #1: | 5'-AGUGGCUUACCCUGAGGUU-3' | (SEQ ID NO: 4563) |
| CKAP5-3890 19 nt Target #2: | 5'-AAGUGGCUUACCCUGAGGU-3' | (SEQ ID NO: 5139) |
| CKAP5-3890 19 nt Target #3: | 5'-AAAGUGGCUUACCCUGAGG-3' | (SEQ ID NO: 5715) |
| CKAP5-3900 19 nt Target #1: | 5'-CCUGAGGUUUUUGACACC-3' | (SEQ ID NO: 4564) |
| CKAP5-3900 19 nt Target #2: | 5'-CCCUGAGGUUUUUGACAC-3' | (SEQ ID NO: 5140) |
| CKAP5-3900 19 nt Target #3: | 5'-ACCCUGAGGUUUUUGACA-3' | (SEQ ID NO: 5716) |
| CKAP5-3918 19 nt Target #1: | 5'-CAAUACAAGCGUCCUGAUG-3' | (SEQ ID NO: 4565) |
| CKAP5-3918 19 nt Target #2: | 5'-CCAAUACAAGCGUCCUGAU-3' | (SEQ ID NO: 5141) |
| CKAP5-3918 19 nt Target #3: | 5'-ACCAAUACAAGCGUCCUGA-3' | (SEQ ID NO: 5717) |
| CKAP5-3928 19 nt Target #1: | 5'-GUCCUGAUGAAAGCACUAG-3' | (SEQ ID NO: 4566) |
| CKAP5-3928 19 nt Target #2: | 5'-CGUCCUGAUGAAAGCACUA-3' | (SEQ ID NO: 5142) |
| CKAP5-3928 19 nt Target #3: | 5'-GCGUCCUGAUGAAAGCACU-3' | (SEQ ID NO: 5718) |
| CKAP5-3934 19 nt Target #1: | 5'-AUGAAAGCACUAGAAUAUU-3' | (SEQ ID NO: 4567) |
| CKAP5-3934 19 nt Target #2: | 5'-GAUGAAAGCACUAGAAUAU-3' | (SEQ ID NO: 5143) |
| CKAP5-3934 19 nt Target #3: | 5'-UGAUGAAAGCACUAGAAUA-3' | (SEQ ID NO: 5719) |
| CKAP5-4367 19 nt Target #1: | 5'-GAAAUCUUUCUGAAAAGGA-3' | (SEQ ID NO: 4568) |
| CKAP5-4367 19 nt Target #2: | 5'-GGAAAUCUUUCUGAAAAGG-3' | (SEQ ID NO: 5144) |
| CKAP5-4367 19 nt Target #3: | 5'-UGGAAAUCUUUCUGAAAAG-3' | (SEQ ID NO: 5720) |
| CKAP5-4378 19 nt Target #1: | 5'-GAAAAGGAUAUGAGCAUGC-3' | (SEQ ID NO: 4569) |
| CKAP5-4378 19 nt Target #2: | 5'-UGAAAAGGAUAUGAGCAUG-3' | (SEQ ID NO: 5145) |
| CKAP5-4378 19 nt Target #3: | 5'-CUGAAAAGGAUAUGAGCAU-3' | (SEQ ID NO: 5721) |
| CKAP5-4487 19 nt Target #1: | 5'-GCUCCAAUGCCAACAUGUU-3' | (SEQ ID NO: 4570) |
| CKAP5-4487 19 nt Target #2: | 5'-AGCUCCAAUGCCAACAUGU-3' | (SEQ ID NO: 5146) |
| CKAP5-4487 19 nt Target #3: | 5'-AAGCUCCAAUGCCAACAUG-3' | (SEQ ID NO: 5722) |

TABLE 7-continued

DsiRNA Component 19 Nucleotide Target Sequences In CKAP5 mRNA

| | | |
|---|---|---|
| CKAP5-4492 19 nt Target #1: | 5'-AAUGCCAACAUGUUACGCA-3' | (SEQ ID NO: 4571) |
| CKAP5-4492 19 nt Target #2: | 5'-CAAUGCCAACAUGUUACGC-3' | (SEQ ID NO: 5147) |
| CKAP5-4492 19 nt Target #3: | 5'-CCAAUGCCAACAUGUUACG-3' | (SEQ ID NO: 5723) |
| CKAP5-4649 19 nt Target #1: | 5'-GUGAAAUGCCAGAACUUGU-3' | (SEQ ID NO: 4572) |
| CKAP5-4649 19 nt Target #2: | 5'-UGUGAAAUGCCAGAACUUG-3' | (SEQ ID NO: 5148) |
| CKAP5-4649 19 nt Target #3: | 5'-AUGUGAAAUGCCAGAACUU-3' | (SEQ ID NO: 5724) |
| CKAP5-4658 19 nt Target #1: | 5'-CAGAACUUGUUCAGCACAA-3' | (SEQ ID NO: 4573) |
| CKAP5-4658 19 nt Target #2: | 5'-CCAGAACUUGUUCAGCACA-3' | (SEQ ID NO: 5149) |
| CKAP5-4658 19 nt Target #3: | 5'-GCCAGAACUUGUUCAGCAC-3' | (SEQ ID NO: 5725) |
| CKAP5-4673 19 nt Target #1: | 5'-ACAAACUGGAUGACAUUUU-3' | (SEQ ID NO: 4574) |
| CKAP5-4673 19 nt Target #2: | 5'-CACAAACUGGAUGACAUUU-3' | (SEQ ID NO: 5150) |
| CKAP5-4673 19 nt Target #3: | 5'-GCACAAACUGGAUGACAUU-3' | (SEQ ID NO: 5726) |
| CKAP5-4681 19 nt Target #1: | 5'-GAUGACAUUUUUGAGCCAG-3' | (SEQ ID NO: 4575) |
| CKAP5-4681 19 nt Target #2: | 5'-GGAUGACAUUUUUGAGCCA-3' | (SEQ ID NO: 5151) |
| CKAP5-4681 19 nt Target #3: | 5'-UGGAUGACAUUUUUGAGCC-3' | (SEQ ID NO: 5727) |
| CKAP5-4686 19 nt Target #1: | 5'-CAUUUUUGAGCCAGUCCUU-3' | (SEQ ID NO: 4576) |
| CKAP5-4686 19 nt Target #2: | 5'-ACAUUUUUGAGCCAGUCCU-3' | (SEQ ID NO: 5152) |
| CKAP5-4686 19 nt Target #3: | 5'-GACAUUUUUGAGCCAGUCC-3' | (SEQ ID NO: 5728) |
| CKAP5-4693 19 nt Target #1: | 5'-GAGCCAGUCCUUAUUCCUG-3' | (SEQ ID NO: 4577) |
| CKAP5-4693 19 nt Target #2: | 5'-UGAGCCAGUCCUUAUUCCU-3' | (SEQ ID NO: 5153) |
| CKAP5-4693 19 nt Target #3: | 5'-UUGAGCCAGUCCUUAUUCC-3' | (SEQ ID NO: 5729) |
| CKAP5-5057 19 nt Target #1: | 5'-CUGGAGUACUAAAAGACCU-3' | (SEQ ID NO: 4578) |
| CKAP5-5057 19 nt Target #2: | 5'-ACUGGAGUACUAAAAGACC-3' | (SEQ ID NO: 5154) |
| CKAP5-5057 19 nt Target #3: | 5'-CACUGGAGUACUAAAAGAC-3' | (SEQ ID NO: 5730) |
| CKAP5-5167 19 nt Target #1: | 5'-GUGAAGGUUCUGGAGAAGU-3' | (SEQ ID NO: 4579) |
| CKAP5-5167 19 nt Target #2: | 5'-GGUGAAGGUUCUGGAGAAG-3' | (SEQ ID NO: 5155) |
| CKAP5-5167 19 nt Target #3: | 5'-UGGUGAAGGUUCUGGAGAA-3' | (SEQ ID NO: 5731) |
| CKAP5-5202 19 nt Target #1: | 5'-CCUGAGUGCCCACUUGUU-3' | (SEQ ID NO: 4580) |
| CKAP5-5202 19 nt Target #2: | 5'-UCCUGAGUGCCCACUUGU-3' | (SEQ ID NO: 5156) |
| CKAP5-5202 19 nt Target #3: | 5'-AUCCUGAGUGCCCACUUG-3' | (SEQ ID NO: 5732) |
| CKAP5-5246 19 nt Target #1: | 5'-CAGCCAGUUCUCCCAAAUU-3' | (SEQ ID NO: 4581) |
| CKAP5-5246 19 nt Target #2: | 5'-ACAGCCAGUUCUCCCAAAU-3' | (SEQ ID NO: 5157) |
| CKAP5-5246 19 nt Target #3: | 5'-AACAGCCAGUUCUCCCAAA-3' | (SEQ ID NO: 5733) |
| CKAP5-5271 19 nt Target #1: | 5'-GCUUGUUAUGAAGUGUCUC-3' | (SEQ ID NO: 4582) |
| CKAP5-5271 19 nt Target #2: | 5'-AGCUUGUUAUGAAGUGUCU-3' | (SEQ ID NO: 5158) |
| CKAP5-5271 19 nt Target #3: | 5'-GAGCUUGUUAUGAAGUGUC-3' | (SEQ ID NO: 5734) |
| CKAP5-5302 19 nt Target #1: | 5'-CGACUGUUGCCUGAUACCA-3' | (SEQ ID NO: 4583) |
| CKAP5-5302 19 nt Target #2: | 5'-UCGACUGUUGCCUGAUACC-3' | (SEQ ID NO: 5159) |
| CKAP5-5302 19 nt Target #3: | 5'-UUCGACUGUUGCCUGAUAC-3' | (SEQ ID NO: 5735) |

TABLE 7-continued

DsiRNA Component 19 Nucleotide Target Sequences In CKAP5 mRNA

| | | |
|---|---|---|
| CKAP5-5307 19 nt Target #1: | 5'-GUUGCCUGAUACCAUCAAU-3' | (SEQ ID NO: 4584) |
| CKAP5-5307 19 nt Target #2: | 5'-UGUUGCCUGAUACCAUCAA-3' | (SEQ ID NO: 5160) |
| CKAP5-5307 19 nt Target #3: | 5'-CUGUUGCCUGAUACCAUCA-3' | (SEQ ID NO: 5736) |
| CKAP5-5312 19 nt Target #1: | 5'-CUGAUACCAUCAAUAGCAU-3' | (SEQ ID NO: 4585) |
| CKAP5-5312 19 nt Target #2: | 5'-CCUGAUACCAUCAAUAGCA-3' | (SEQ ID NO: 5161) |
| CKAP5-5312 19 nt Target #3: | 5'-GCCUGAUACCAUCAAUAGC-3' | (SEQ ID NO: 5737) |
| CKAP5-5320 19 nt Target #1: | 5'-AUCAAUAGCAUUAACCUAG-3' | (SEQ ID NO: 4586) |
| CKAP5-5320 19 nt Target #2: | 5'-CAUCAAUAGCAUUAACCUA-3' | (SEQ ID NO: 5162) |
| CKAP5-5320 19 nt Target #3: | 5'-CCAUCAAUAGCAUUAACCU-3' | (SEQ ID NO: 5738) |
| CKAP5-5325 19 nt Target #1: | 5'-UAGCAUUAACCUAGACAGA-3' | (SEQ ID NO: 4587) |
| CKAP5-5325 19 nt Target #2: | 5'-AUAGCAUUAACCUAGACAG-3' | (SEQ ID NO: 5163) |
| CKAP5-5325 19 nt Target #3: | 5'-AAUAGCAUUAACCUAGACA-3' | (SEQ ID NO: 5739) |
| CKAP5-5342 19 nt Target #1: | 5'-GAAUUCUUCUGGAUAUCCA-3' | (SEQ ID NO: 4588) |
| CKAP5-5342 19 nt Target #2: | 5'-AGAAUUCUUCUGGAUAUCC-3' | (SEQ ID NO: 5164) |
| CKAP5-5342 19 nt Target #3: | 5'-CAGAAUUCUUCUGGAUAUC-3' | (SEQ ID NO: 5740) |
| CKAP5-5350 19 nt Target #1: | 5'-CUGGAUAUCCACAUUUUCA-3' | (SEQ ID NO: 4589) |
| CKAP5-5350 19 nt Target #2: | 5'-UCUGGAUAUCCACAUUUUC-3' | (SEQ ID NO: 5165) |
| CKAP5-5350 19 nt Target #3: | 5'-UUCUGGAUAUCCACAUUUU-3' | (SEQ ID NO: 5741) |
| CKAP5-5383 19 nt Target #1: | 5'-AAAGAGAAACUGAAGCAAU-3' | (SEQ ID NO: 4590) |
| CKAP5-5383 19 nt Target #2: | 5'-CAAAGAGAAACUGAAGCAA-3' | (SEQ ID NO: 5166) |
| CKAP5-5383 19 nt Target #3: | 5'-CCAAAGAGAAACUGAAGCA-3' | (SEQ ID NO: 5742) |
| CKAP5-5388 19 nt Target #1: | 5'-GAAACUGAAGCAAUGCAAA-3' | (SEQ ID NO: 4591) |
| CKAP5-5388 19 nt Target #2: | 5'-AGAAACUGAAGCAAUGCAA-3' | (SEQ ID NO: 5167) |
| CKAP5-5388 19 nt Target #3: | 5'-GAGAAACUGAAGCAAUGCA-3' | (SEQ ID NO: 5743) |
| CKAP5-5536 19 nt Target #1: | 5'-CGGAUGAUGAAGCACAGUA-3' | (SEQ ID NO: 4592) |
| CKAP5-5536 19 nt Target #2: | 5'-CCGGAUGAUGAAGCACAGU-3' | (SEQ ID NO: 5168) |
| CKAP5-5536 19 nt Target #3: | 5'-GCCGGAUGAUGAAGCACAG-3' | (SEQ ID NO: 5744) |
| CKAP5-5588 19 nt Target #1: | 5'-CAGAAAAGGGAGCAUCUCG-3' | (SEQ ID NO: 4593) |
| CKAP5-5588 19 nt Target #2: | 5'-ACAGAAAAGGGAGCAUCUC-3' | (SEQ ID NO: 5169) |
| CKAP5-5588 19 nt Target #3: | 5'-AACAGAAAAGGGAGCAUCU-3' | (SEQ ID NO: 5745) |
| CKAP5-5594 19 nt Target #1: | 5'-AGGGAGCAUCUCGAAUAGA-3' | (SEQ ID NO: 4594) |
| CKAP5-5594 19 nt Target #2: | 5'-AAGGGAGCAUCUCGAAUAG-3' | (SEQ ID NO: 5170) |
| CKAP5-5594 19 nt Target #3: | 5'-AAAGGGAGCAUCUCGAAUA-3' | (SEQ ID NO: 5746) |
| CKAP5-5599 19 nt Target #1: | 5'-GCAUCUCGAAUAGAUGAAA-3' | (SEQ ID NO: 4595) |
| CKAP5-5599 19 nt Target #2: | 5'-AGCAUCUCGAAUAGAUGAA-3' | (SEQ ID NO: 5171) |
| CKAP5-5599 19 nt Target #3: | 5'-GAGCAUCUCGAAUAGAUGA-3' | (SEQ ID NO: 5747) |
| CKAP5-5692 19 nt Target #1: | 5'-GAGGGACUAGCAGAGUUAU-3' | (SEQ ID NO: 4596) |
| CKAP5-5692 19 nt Target #2: | 5'-AGAGGGACUAGCAGAGUUA-3' | (SEQ ID NO: 5172) |
| CKAP5-5692 19 nt Target #3: | 5'-AAGAGGGACUAGCAGAGUU-3' | (SEQ ID NO: 5748) |

TABLE 7-continued

DsiRNA Component 19 Nucleotide Target Sequences In CKAP5 mRNA

| | | |
|---|---|---|
| CKAP5-5729 19 nt Target #1: | 5'-ACUCAGAUGCUGACAUUGA-3' | (SEQ ID NO: 4597) |
| CKAP5-5729 19 nt Target #2: | 5'-UACUCAGAUGCUGACAUUG-3' | (SEQ ID NO: 5173) |
| CKAP5-5729 19 nt Target #3: | 5'-AUACUCAGAUGCUGACAUU-3' | (SEQ ID NO: 5749) |
| CKAP5-6130 19 nt Target #1: | 5'-CAUUCAGACCUGGAUUCUA-3' | (SEQ ID NO: 4598) |
| CKAP5-6130 19 nt Target #2: | 5'-GCAUUCAGACCUGGAUUCU-3' | (SEQ ID NO: 5174) |
| CKAP5-6130 19 nt Target #3: | 5'-AGCAUUCAGACCUGGAUUC-3' | (SEQ ID NO: 5750) |
| CKAP5-6136 19 nt Target #1: | 5'-GACCUGGAUUCUAACCAGA-3' | (SEQ ID NO: 4599) |
| CKAP5-6136 19 nt Target #2: | 5'-AGACCUGGAUUCUAACCAG-3' | (SEQ ID NO: 5175) |
| CKAP5-6136 19 nt Target #3: | 5'-CAGACCUGGAUUCUAACCA-3' | (SEQ ID NO: 5751) |
| CKAP5-6141 19 nt Target #1: | 5'-GGAUUCUAACCAGACUCAC-3' | (SEQ ID NO: 4600) |
| CKAP5-6141 19 nt Target #2: | 5'-UGGAUUCUAACCAGACUCA-3' | (SEQ ID NO: 5176) |
| CKAP5-6141 19 nt Target #3: | 5'-CUGGAUUCUAACCAGACUC-3' | (SEQ ID NO: 5752) |
| CKAP5-6193 19 nt Target #1: | 5'-GCUAACAUAGACGACUUGA-3' | (SEQ ID NO: 4601) |
| CKAP5-6193 19 nt Target #2: | 5'-AGCUAACAUAGACGACUUG-3' | (SEQ ID NO: 5177) |
| CKAP5-6193 19 nt Target #3: | 5'-CAGCUAACAUAGACGACUU-3' | (SEQ ID NO: 5753) |
| CKAP5-6198 19 nt Target #1: | 5'-CAUAGACGACUUGAAAAAA-3' | (SEQ ID NO: 4602) |
| CKAP5-6198 19 nt Target #2: | 5'-ACAUAGACGACUUGAAAAA-3' | (SEQ ID NO: 5178) |
| CKAP5-6198 19 nt Target #3: | 5'-AACAUAGACGACUUGAAAA-3' | (SEQ ID NO: 5754) |
| CKAP5-6294 19 nt Target #1: | 5'-CUAGAAGUCCUCAUAGUUU-3' | (SEQ ID NO: 4603) |
| CKAP5-6294 19 nt Target #2: | 5'-ACUAGAAGUCCUCAUAGUU-3' | (SEQ ID NO: 5179) |
| CKAP5-6294 19 nt Target #3: | 5'-AACUAGAAGUCCUCAUAGU-3' | (SEQ ID NO: 5755) |
| CKAP5-6459 19 nt Target #1: | 5'-GAUGAGUUUAGUGUACAGA-3' | (SEQ ID NO: 4604) |
| CKAP5-6459 19 nt Target #2: | 5'-GGAUGAGUUUAGUGUACAG-3' | (SEQ ID NO: 5180) |
| CKAP5-6459 19 nt Target #3: | 5'-UGGAUGAGUUUAGUGUACA-3' | (SEQ ID NO: 5756) |
| CKAP5-6517 19 nt Target #1: | 5'-CAGAUCCUUUUCUUUUCUU-3' | (SEQ ID NO: 4605) |
| CKAP5-6517 19 nt Target #2: | 5'-CCAGAUCCUUUUCUUUUCU-3' | (SEQ ID NO: 5181) |
| CKAP5-6517 19 nt Target #3: | 5'-CCCAGAUCCUUUUCUUUUC-3' | (SEQ ID NO: 5757) |
| CKAP5-6542 19 nt Target #1: | 5'-UGCUCAUUUGUAAAAUUGU-3' | (SEQ ID NO: 4606) |
| CKAP5-6542 19 nt Target #2: | 5'-UUGCUCAUUUGUAAAAUUG-3' | (SEQ ID NO: 5182) |
| CKAP5-6542 19 nt Target #3: | 5'-AUUGCUCAUUUGUAAAAUU-3' | (SEQ ID NO: 5758) |
| CKAP5-6648 19 nt Target #1: | 5'-GAAGGGUCACUGUAUUCUG-3' | (SEQ ID NO: 4607) |
| CKAP5-6648 19 nt Target #2: | 5'-UGAAGGGUCACUGUAUUCU-3' | (SEQ ID NO: 5183) |
| CKAP5-6648 19 nt Target #3: | 5'-CUGAAGGGUCACUGUAUUC-3' | (SEQ ID NO: 5759) |
| CKAP5-6653 19 nt Target #1: | 5'-GUCACUGUAUUCUGUAUGA-3' | (SEQ ID NO: 4608) |
| CKAP5-6653 19 nt Target #2: | 5'-GGUCACUGUAUUCUGUAUG-3' | (SEQ ID NO: 5184) |
| CKAP5-6653 19 nt Target #3: | 5'-GGGUCACUGUAUUCUGUAU-3' | (SEQ ID NO: 5760) |

Within Tables 2-7 above, underlined residues indicate 2'-O-methyl residues, UPPER CASE indicates ribonucleotides, and lower case denotes deoxyribonucleotides. The DsiRNA agents of Tables 2-3 above are 25/27mer agents possessing a blunt end. The structures and/or modification patterning of the agents of Tables 2-3 above can be readily adapted to the above generic sequence structures, e.g., the 3' overhang of the second strand can be extended or contracted, 2'-O-methylation of the second strand can be expanded towards the 5' end of the second strand, optionally at alternating sites, etc. Such further modifications are optional, as 25/27mer DsiRNAs with such modifications can also be readily designed from the above DsiRNA agents and are also expected to be functional inhibitors of CKAP5 expression. Similarly, the 27mer "blunt/fray" and "blunt/blunt" DsiRNA structures and/or modification patterns of the agents of Tables 5-6 above can also be readily adapted to the above generic sequence structures, e.g., for application of modification patterning of the antisense strand to such structures and/or adaptation of such sequences to the above generic structures.

In certain embodiments, 27mer DsiRNAs possessing independent strand lengths each of 27 nucleotides are designed and synthesized for targeting of the same sites within the CKAP5 transcript as the asymmetric "25/27" structures shown in Tables 2-3 herein. Exemplary "27/27" DsiRNAs are optionally designed with a "blunt/fray" structure as shown for the DsiRNAs of Table 5 above, or with a "blunt/blunt" structure as shown for the DsiRNAs of Table 6 above.

In certain embodiments, the dsRNA agents of the invention require, e.g., at least 19, at least 20, at least 21, at least 22, at least 23, at least 24, at least 25 or at least 26 residues of the first strand to be complementary to corresponding residues of the second strand. In certain related embodiments, these first strand residues complementary to corresponding residues of the second strand are optionally consecutive residues.

By definition, "sufficiently complementary" (contrasted with, e.g., "100% complementary") allows for one or more mismatches to exist between a dsRNA of the invention and the target RNA or cDNA sequence (e.g., CKAP5 mRNA), provided that the dsRNA possesses complementarity sufficient to trigger the destruction of the target RNA by the RNAi machinery (e.g., the RISC complex) or process. In certain embodiments, a "sufficiently complementary" dsRNA of the invention can harbor one, two, three or even four or more mismatches between the dsRNA sequence and the target RNA or cDNA sequence (e.g., in certain such embodiments, the antisense strand of the dsRNA harbors one, two, three, four, five or even six or more mismatches when aligned with the target RNA or cDNA sequence). Additional consideration of the preferred location of such mismatches within certain dsRNAs of the instant invention is considered in greater detail below.

As used herein "DsiRNAmm" refers to a DisRNA having a "mismatch tolerant region" containing one, two, three or four mismatched base pairs of the duplex formed by the sense and antisense strands of the DsiRNA, where such mismatches are positioned within the DsiRNA at a location(s) lying between (and thus not including) the two terminal base pairs of either end of the DsiRNA. The mismatched base pairs are located within a "mismatch-tolerant region" which is defined herein with respect to the location of the projected Ago2 cut site of the corresponding target nucleic acid. The mismatch tolerant region is located "upstream of" the projected Ago2 cut site of the target strand. "Upstream" in this context will be understood as the 5'-most portion of the DsiRNAmm duplex, where 5' refers to the orientation of the sense strand of the DsiRNA duplex. Therefore, the mismatch tolerant region is upstream of the base on the sense (passenger) strand that corresponds to the projected Ago2 cut site of the target nucleic acid (see FIG. 1); alternatively, when referring to the antisense (guide) strand of the DsiRNAmm, the mismatch tolerant region can also be described as positioned downstream of the base that is complementary to the projected Ago2 cut site of the target nucleic acid, that is, the 3'-most portion of the antisense strand of the DsiRNAmm (where position 1 of the antisense strand is the 5' terminal nucleotide of the antisense strand, see FIG. 1).

In one embodiment, for example with numbering as depicted in FIG. 1, the mismatch tolerant region is positioned between and including base pairs 3-9 when numbered from the nucleotide starting at the 5' end of the sense strand of the duplex. Therefore, a DsiRNAmm of the invention possesses a single mismatched base pair at any one of positions 3, 4, 5, 6, 7, 8 or 9 of the sense strand of a right-hand extended DsiRNA (where position 1 is the 5' terminal nucleotide of the sense strand and position 9 is the nucleotide residue of the sense strand that is immediately 5' of the projected Ago2 cut site of the target CKAP5 RNA sequence corresponding to the sense strand sequence). In certain embodiments, for a DsiRNAmm that possesses a mismatched base pair nucleotide at any of positions 3, 4, 5, 6, 7, 8 or 9 of the sense strand, the corresponding mismatched base pair nucleotide of the antisense strand not only forms a mismatched base pair with the DsiRNAmm sense strand sequence, but also forms a mismatched base pair with a DsiRNAmm target CKAP5 RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target CKAP5 RNA sequence). In alternative embodiments, the mismatch base pair nucleotide of the antisense strand of a DsiRNAmm only form a mismatched base pair with a corresponding nucleotide of the sense strand sequence of the DsiRNAmm, yet base pairs with its corresponding target CKAP5 RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target CKAP5 RNA sequence).

A DsiRNAmm of the invention that possesses a single mismatched base pair within the mismatch-tolerant region (mismatch region) as described above (e.g., a DsiRNAmm harboring a mismatched nucleotide residue at any one of positions 3, 4, 5, 6, 7, 8 or 9 of the sense strand) can further include one, two or even three additional mismatched base pairs. In preferred embodiments, these one, two or three additional mismatched base pairs of the DsiRNAmm occur at position(s) 3, 4, 5, 6, 7, 8 and/or 9 of the sense strand (and at corresponding residues of the antisense strand). In one embodiment where one additional mismatched base pair is present within a DsiRNAmm, the two mismatched base pairs of the sense strand can occur, e.g., at nucleotides of both position 4 and position 6 of the sense strand (with mismatch also occurring at corresponding nucleotide residues of the antisense strand).

In DsiRNAmm agents possessing two mismatched base pairs, mismatches can occur consecutively (e.g., at consecutive positions along the sense strand nucleotide sequence). Alternatively, nucleotides of the sense strand that form mismatched base pairs with the antisense strand sequence can be interspersed by nucleotides that base pair with the antisense strand sequence (e.g., for a DsiRNAmm possessing mismatched nucleotides at positions 3 and 6, but not at positions 4 and 5, the mismatched residues of sense strand positions 3 and 6 are interspersed by two nucleotides that form matched base pairs with corresponding residues of the antisense strand). For example, two residues of the sense strand (located within the mismatch-tolerant region of the sense strand) that form mismatched base pairs with the corresponding antisense strand sequence can occur with zero, one, two, three, four or five matched base pairs located between these mismatched base pairs.

For certain DsiRNAmm agents possessing three mismatched base pairs, mismatches can occur consecutively (e.g., in a triplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 4 and 8, but not at positions 5, 6 and 7, the mismatched residues of sense strand positions 3 and 4 are adjacent to one another, while the mismatched residues of sense strand positions 4 and 8 are interspersed by three nucleotides that form matched base pairs with corresponding residues of the antisense strand). For example, three residues of the sense strand (located within the mismatch-tolerant region of the sense strand) that form mismatched base pairs with the corresponding antisense strand sequence can occur with zero, one, two, three or four matched base pairs located between any two of these mismatched base pairs.

For certain DsiRNAmm agents possessing four mismatched base pairs, mismatches can occur consecutively (e.g., in a quadruplet along the sense strand nucleotide sequence). Alternatively, nucleotides of the sense strand that form mismatched base pairs with the antisense strand sequence can be interspersed by nucleotides that form matched base pairs with the antisense strand sequence (e.g., for a DsiRNAmm possessing mismatched nucleotides at positions 3, 5, 7 and 8, but not at positions 4 and 6, the mismatched residues of sense strand positions 7 and 8 are adjacent to one another, while the mismatched residues of sense strand positions 3 and 5 are interspersed by one nucleotide that forms a matched base pair with the corresponding residue of the antisense strand—similarly, the mismatched residues of sense strand positions 5 and 7 are also interspersed by one nucleotide that forms a matched base pair with the corresponding residue of the antisense strand). For example, four residues of the sense strand (located within the mismatch-tolerant region of the sense strand) that form mismatched base pairs with the corresponding antisense strand sequence can occur with zero, one, two or three matched base pairs located between any two of these mismatched base pairs.

In another embodiment, for example with numbering also as depicted in FIG. 1, a DsiRNAmm of the invention comprises a mismatch tolerant region which possesses a single mismatched base pair nucleotide at any one of positions 17, 18, 19, 20, 21, 22 or 23 of the antisense strand of the DsiRNA (where position 1 is the 5' terminal nucleotide of the antisense strand and position 17 is the nucleotide residue of the antisense strand that is immediately 3' (downstream) in the antisense strand of the projected Ago2 cut site of the target CKAP5 RNA sequence sufficiently complementary to the antisense strand sequence). In certain embodiments, for a DsiRNAmm that possesses a mismatched base pair nucleotide at any of positions 17, 18, 19, 20, 21, 22 or 23 of the antisense strand with respect to the sense strand of the DsiRNAmm, the mismatched base pair nucleotide of the antisense strand not only forms a mismatched base pair with the DsiRNAmm sense strand sequence, but also forms a mismatched base pair with a DsiRNAmm target CKAP5 RNA sequence (thus, complementarity between the antisense strand sequence and the sense strand sequence is disrupted at the mismatched base pair within the DsiRNAmm, and complementarity is similarly disrupted between the antisense strand sequence of the DsiRNAmm and the target CKAP5 RNA sequence). In alternative embodiments, the mismatch base pair nucleotide of the antisense strand of a DsiRNAmm only forms a mismatched base pair with a corresponding nucleotide of the sense strand sequence of the DsiRNAmm, yet base pairs with its corresponding target CKAP5 RNA sequence nucleotide (thus, complementarity between the antisense strand sequence and the sense strand sequence is disrupted at the mismatched base pair within the DsiRNAmm, yet complementarity is maintained between the antisense strand sequence of the DsiRNAmm and the target CKAP5 RNA sequence).

A DsiRNAmm of the invention that possesses a single mismatched base pair within the mismatch-tolerant region as described above (e.g., a DsiRNAmm harboring a mismatched nucleotide residue at positions 17, 18, 19, 20, 21, 22 or 23 of the antisense strand) can further include one, two or even three additional mismatched base pairs. In preferred embodiments, these one, two or three additional mismatched base pairs of the DsiRNAmm occur at position(s) 17, 18, 19, 20, 21, 22 and/or 23 of the antisense strand (and at corresponding residues of the sense strand). In one embodiment where one additional mismatched base pair is present within a DsiRNAmm, the two mismatched base pairs of the antisense strand can occur, e.g., at nucleotides of both position 18 and position 20 of the antisense strand (with mismatch also occurring at corresponding nucleotide residues of the sense strand).

In DsiRNAmm agents possessing two mismatched base pairs, mismatches can occur consecutively (e.g., at consecutive positions along the antisense strand nucleotide sequence). Alternatively, nucleotides of the antisense strand that form mismatched base pairs with the sense strand sequence can be interspersed by nucleotides that base pair with the sense strand sequence (e.g., for a DsiRNAmm possessing mismatched nucleotides at positions 17 and 20, but not at positions 18 and 19, the mismatched residues of antisense strand positions 17 and 20 are interspersed by two nucleotides that form matched base pairs with corresponding residues of the sense strand). For example, two residues of the antisense strand (located within the mismatch-tolerant region of the sense strand) that form mismatched base pairs with the corresponding sense strand sequence can occur with zero, one, two, three, four, five, six or seven matched base pairs located between these mismatched base pairs.

For certain DsiRNAmm agents possessing three mismatched base pairs, mismatches can occur consecutively (e.g., in a triplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 17, 18 and 22, but not at positions 19, 20 and 21, the mismatched residues of antisense strand positions 17 and 18 are adjacent to one another, while the mismatched residues of antisense strand positions 18 and 122 are interspersed by three nucleotides that form matched base pairs with corresponding residues of the sense strand). For example, three residues of the antisense strand (located within the mismatch-tolerant region of the antisense strand) that form mismatched base pairs with the corresponding sense strand sequence can occur with zero, one, two, three, four, five or six matched base pairs located between any two of these mismatched base pairs.

For certain DsiRNAmm agents possessing four mismatched base pairs, mismatches can occur consecutively (e.g., in a quadruplet along the antisense strand nucleotide sequence). Alternatively, nucleotides of the antisense strand that form mismatched base pairs with the sense strand sequence can be interspersed by nucleotides that form matched base pairs with the sense strand sequence (e.g., for a DsiRNAmm possessing mismatched nucleotides at positions 18, 20, 22 and 23, but not at positions 19 and 21, the mismatched residues of antisense strand positions 22 and 23 are adjacent to one another, while the mismatched residues of antisense strand positions 18 and 20 are interspersed by one nucleotide that forms a matched base pair with the corresponding residue of the sense strand—similarly, the mismatched residues of antisense strand positions 20 and 22 are also interspersed by one nucleotide that forms a matched base pair with the corresponding residue of the sense strand). For example, four residues of the antisense strand (located within the mismatch-tolerant region of the antisense strand) that form mismatched base pairs with the corresponding sense strand sequence can occur with zero, one, two, three, four or five matched base pairs located between any two of these mismatched base pairs.

For reasons of clarity, the location(s) of mismatched nucleotide residues within the above DsiRNAmm agents are numbered in reference to the 5' terminal residue of either sense or antisense strands of the DsiRNAmm. The numbering of positions located within the mismatch-tolerant region (mismatch region) of the antisense strand can shift with variations in the proximity of the 5' terminus of the sense or antisense strand to the projected Ago2 cleavage site. Thus, the location(s) of preferred mismatch sites within either antisense strand or sense strand can also be identified as the permissible proximity of such mismatches to the projected Ago2 cut site. Accordingly, in one preferred embodiment, the position of a mismatch nucleotide of the sense strand of a DsiRNAmm is the nucleotide residue of the sense strand that is located immediately 5' (upstream) of the projected Ago2 cleavage site of the corresponding target CKAP5 RNA sequence. In other preferred embodiments, a mismatch nucleotide of the sense strand of a DsiRNAmm is positioned at the nucleotide residue of the sense strand that is located two nucleotides 5' (upstream) of the projected Ago2 cleavage site, three nucleotides 5' (upstream) of the projected Ago2 cleavage site, four nucleotides 5' (upstream) of the projected Ago2 cleavage site, five nucleotides 5' (upstream) of the projected Ago2 cleavage site, six nucleotides 5' (upstream) of the projected Ago2 cleavage site, seven nucleotides 5' (upstream) of the projected Ago2 cleavage site, eight nucleotides 5' (upstream) of the projected Ago2 cleavage site, or nine nucleotides 5' (upstream) of the projected Ago2 cleavage site.

Exemplary single mismatch-containing 25/27mer DsiRNAs (DsiRNAmm) include the following structures (such mismatch-containing structures may also be incorporated into other exemplary DsiRNA structures shown herein).

5'-XX$^M$XXXXXXXXXXXXXXXXXXXXXDD-3'
3'-XXXX$_M$XXXXXXXXXXXXXXXXXXXXXXX-5'

5'-XXX$^M$XXXXXXXXXXXXXXXXXXXXXDD-3'
3'-XXXXX$_M$XXXXXXXXXXXXXXXXXXXXXX-5'

-continued

5'-XXXX$^M$XXXXXXXXXXXXXXXXXXXXDD-3'
3'-XXXXXX$_M$XXXXXXXXXXXXXXXXXXXXX-5'

5'-XXXXX$^M$XXXXXXXXXXXXXXXXXXXDD-3'
3'-XXXXXXX$_M$XXXXXXXXXXXXXXXXXXXX-5'

5'-XXXXXX$^M$XXXXXXXXXXXXXXXXXXDD-3'
3'-XXXXXXXX$_M$XXXXXXXXXXXXXXXXXXX-5'

5'-XXXXXXX$^M$XXXXXXXXXXXXXXXXXDD-3'
3'-XXXXXXXXX$_M$XXXXXXXXXXXXXXXXXX-5'

5'-XXXXXXXX$^M$XXXXXXXXXXXXXXXXDD-3'
3'-XXXXXXXXXX$_M$XXXXXXXXXXXXXXXXX-5' wherein "X"=RNA, "D"=DNA and "M"=Nucleic acid residues (RNA, DNA or non-natural or modified nucleic acids) that do not base pair (hydrogen bond) with corresponding "M" residues of otherwise complementary strand when strands are annealed. Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNAmm agents. For the above mismatch structures, the top strand is the sense strand, and the bottom strand is the antisense strand.

In certain embodiments, a DsiRNA of the invention can contain mismatches that exist in reference to the target CKAP5 RNA sequence yet do not necessarily exist as mismatched base pairs within the two strands of the DsiRNA—thus, a DsiRNA can possess perfect complementarity between first and second strands of a DsiRNA, yet still possess mismatched residues in reference to a target CKAP5 RNA (which, in certain embodiments, may be advantageous in promoting efficacy and/or potency and/or duration of effect). In certain embodiments, where mismatches occur between antisense strand and target CKAP5 RNA sequence, the position of a mismatch is located within the antisense strand at a position(s) that corresponds to a sequence of the sense strand located 5' of the projected Ago2 cut site of the target region—e.g., antisense strand residue(s) positioned within the antisense strand to the 3' of the antisense residue which is complementary to the projected Ago2 cut site of the target sequence.

Exemplary 25/27mer DsiRNAs that harbor a single mismatched residue in reference to target sequences include the following structures.

```
Target RNA Sequence:
5'- . . . AXXXXXXXXXXXXXXXXXX . . . -3'

DsiRNAmm Sense Strand:
5'-XXXXXXXXXXXXXXXXXXXXXXXXDD-3'

DsiRNAmm Antisense Strand:
3'-EXXXXXXXXXXXXXXXXXXXXXXXXX-5'

Target RNA Sequence:
5'- . . . XAXXXXXXXXXXXXXXXXX . . . -3'

DsiRNAmm Sense Strand:
5'-XXXXXXXXXXXXXXXXXXXXXXXXDD-3'

DsiRNAmm Antisense Strand:
3'-XEXXXXXXXXXXXXXXXXXXXXXXXX-5'

Target RNA Sequence:
5'- . . . AXXXXXXXXXXXXXXXXX . . . -3'
```

```
-continued
DsiRNAmm Sense Strand:
5'-BXXXXXXXXXXXXXXXXXXXXXDD-3'

DsiRNAmm Antisense Strand:
3'-XXEXXXXXXXXXXXXXXXXXXXXXXXX-5'

Target RNA Sequence:
5'- . . . XAXXXXXXXXXXXXXXXX . . . -3'

DsiRNAmm Sense Strand:
5'-XBXXXXXXXXXXXXXXXXXXXXDD-3'

DsiRNAmm Antisense Strand:
3'-XXXEXXXXXXXXXXXXXXXXXXXXXXX-5'

Target RNA Sequence:
5'- . . . XXAXXXXXXXXXXXXXXX . . . -3'

DsiRNAmm Sense Strand:
5'-XXBXXXXXXXXXXXXXXXXXXXDD-3'

DsiRNAmm Antisense Strand:
3'-XXXXEXXXXXXXXXXXXXXXXXXXXXX-5'

Target RNA Sequence:
5'- . . . XXXAXXXXXXXXXXXXXX . . . -3'

DsiRNAmm Sense Strand:
5'-XXXBXXXXXXXXXXXXXXXXXXDD-3'

DsiRNAmm Antisense Strand:
3'-XXXXXEXXXXXXXXXXXXXXXXXXXXX-5'

Target RNA Sequence:
5'- . . . XXXXAXXXXXXXXXXXXX . . . -3'

DsiRNAmm Sense Strand:
5'-XXXXBXXXXXXXXXXXXXXXXXDD-3'

DsiRNAmm Antisense Strand:
3'-XXXXXXEXXXXXXXXXXXXXXXXXXXX-5'

Target RNA Sequence:
5'- . . . XXXXXAXXXXXXXXXXXX . . . -3'

DsiRNAmm Sense Strand:
5'-XXXXXBXXXXXXXXXXXXXXXXDD-3'

DsiRNAmm Antisense Strand:
3'-XXXXXXXEXXXXXXXXXXXXXXXXXXX-5'

Target RNA Sequence:
5'- . . . XXXXXXAXXXXXXXXXXX . . . -3'

DsiRNAmm Sense Strand:
5'-XXXXXXBXXXXXXXXXXXXXXXDD-3'

DsiRNAmm Antisense Strand:
3'-XXXXXXXXEXXXXXXXXXXXXXXXXXX-5'

Target RNA Sequence:
5'- . . . XXXXXXXAXXXXXXXXXX . . . -3'

DsiRNAmm Sense Strand:
5'-XXXXXXXBXXXXXXXXXXXXXXDD-3'

DsiRNAmm Antisense Strand:
3'-XXXXXXXXXEXXXXXXXXXXXXXXXXX-5'

Target RNA Sequence:
5'- . . . XXXXXXXXAXXXXXXXXX . . . -3'

DsiRNAmm Sense Strand:
5'-XXXXXXXXBXXXXXXXXXXXXXDD-3'

DsiRNAmm Antisense Strand:
3'-XXXXXXXXXXEXXXXXXXXXXXXXXXX-5'
``` wherein "X"=RNA, "D"=DNA and "E"=Nucleic acid residues (RNA, DNA or non-natural or modified nucleic acids) that do not base pair (hydrogen bond) with corresponding "A" RNA residues of otherwise complementary (target) strand when strands are annealed, yet optionally do base pair with corresponding "B" residues ("B" residues are also RNA, DNA or non-natural or modified nucleic acids). Any of the residues of such agents can optionally be 2'-O-methyl RNA monomers—alternating positioning of 2'-O-methyl RNA monomers that commences from the 3'-terminal residue of the bottom (second) strand, as shown above, can also be used in the above DsiRNA agents.

In certain embodiments, the guide strand of a dsRNA of the invention that is sufficiently complementary to a target RNA (e.g., mRNA) along at least 19 nucleotides of the target gene sequence to reduce target gene expression is not perfectly complementary to the at least 19 nucleotide long target gene sequence. Rather, it is appreciated that the guide strand of a dsRNA of the invention that is sufficiently complementary to a target mRNA along at least 19 nucleotides of a target RNA sequence to reduce target gene expression can have one, two, three, or even four or more nucleotides that are mismatched with the 19 nucleotide or longer target strand sequence. Thus, for a 19 nucleotide target RNA sequence, the guide strand of a dsRNA of the invention can be sufficiently complementary to the target RNA sequence to reduce target gene levels while possessing, e.g., only 15/19, 16/19, 17/19 or 18/19 matched nucleotide residues between guide strand and target RNA sequence.

In addition to the above-exemplified structures, dsRNAs of the invention can also possess one, two or three additional residues that form further mismatches with the target CKAP5 RNA sequence. Such mismatches can be consecutive, or can be interspersed by nucleotides that form matched base pairs with the target CKAP5 RNA sequence. Where interspersed by nucleotides that form matched base pairs, mismatched residues can be spaced apart from each other within a single strand at an interval of one, two, three, four, five, six, seven or even eight base paired nucleotides between such mismatch-forming residues.

As for the above-described DsiRNAmm agents, a preferred location within dsRNAs (e.g., DsiRNAs) for antisense strand nucleotides that form mismatched base pairs with target CKAP5 RNA sequence (yet may or may not form mismatches with corresponding sense strand nucleotides) is within the antisense strand region that is located 3' (downstream) of the antisense strand sequence which is complementary to the projected Ago2 cut site of the DsiRNA (e.g., in FIG. 1, the region of the antisense strand which is 3' of the projected Ago2 cut site is preferred for mismatch-forming residues and happens to be located at positions 17-23 of the antisense strand for the 25/27mer agent shown in FIG. 1). Thus, in one embodiment, the position of a mismatch nucleotide (in relation to the target CKAP5 RNA sequence) of the antisense strand of a DsiRNAmm is the nucleotide residue of the antisense strand that is located immediately 3' (downstream) within the antisense strand sequence of the projected Ago2 cleavage site of the corresponding target CKAP5 RNA sequence. In other preferred embodiments, a mismatch nucleotide of the antisense strand of a DsiRNAmm (in relation to the target CKAP5 RNA sequence) is positioned at the nucleotide residue of the antisense strand that is located two nucleotides 3' (downstream) of the corresponding projected Ago2 cleavage site, three nucleotides 3' (downstream) of the corresponding projected Ago2 cleavage site, four nucleotides 3' (downstream) of the corresponding projected Ago2 cleavage site, five nucleotides 3' (downstream) of the corresponding projected Ago2 cleavage site, six nucleotides 3' (downstream) of the projected Ago2 cleavage site, seven nucleotides 3' (downstream) of the projected Ago2 cleavage site, eight nucleotides 3' (downstream) of the projected Ago2 cleavage site, or nine nucleotides 3' (downstream) of the projected Ago2 cleavage site.

In dsRNA agents possessing two mismatch-forming nucleotides of the antisense strand (where mismatch-forming nucleotides are mismatch forming in relation to target CKAP5 RNA sequence), mismatches can occur consecutively (e.g., at consecutive positions along the antisense strand nucleotide sequence). Alternatively, nucleotides of the antisense strand that form mismatched base pairs with the target CKAP5 RNA sequence can be interspersed by nucleotides that base pair with the target CKAP5 RNA sequence (e.g., for a DsiRNA possessing mismatch-forming nucleotides at positions 17 and 20 (starting from the 5' terminus (position 1) of the antisense strand of the 25/27mer agent shown in FIG. 1), but not at positions 18 and 19, the mismatched residues of sense strand positions 17 and 20 are interspersed by two nucleotides that form matched base pairs with corresponding residues of the target CKAP5 RNA sequence). For example, two residues of the antisense strand (located within the mismatch-tolerant region of the antisense strand) that form mismatched base pairs with the corresponding target CKAP5 RNA sequence can occur with zero, one, two, three, four or five matched base pairs (with respect to target CKAP5 RNA sequence) located between these mismatch-forming base pairs.

For certain dsRNAs possessing three mismatch-forming base pairs (mismatch-forming with respect to target CKAP5 RNA sequence), mismatch-forming nucleotides can occur consecutively (e.g., in a triplet along the antisense strand nucleotide sequence). Alternatively, nucleotides of the antisense strand that form mismatched base pairs with the target CKAP5 RNA sequence can be interspersed by nucleotides that form matched base pairs with the target CKAP5 RNA sequence (e.g., for a DsiRNA possessing mismatched nucleotides at positions 17, 18 and 22, but not at positions 19, 20 and 21, the mismatch-forming residues of antisense strand positions 17 and 18 are adjacent to one another, while the mismatch-forming residues of antisense strand positions 18 and 22 are interspersed by three nucleotides that form matched base pairs with corresponding residues of the target CKAP5 RNA). For example, three residues of the antisense strand (located within the mismatch-tolerant region of the antisense strand) that form mismatched base pairs with the corresponding target CKAP5 RNA sequence can occur with zero, one, two, three or four matched base pairs located between any two of these mismatch-forming base pairs.

For certain dsRNAs possessing four mismatch-forming base pairs (mismatch-forming with respect to target CKAP5 RNA sequence), mismatch-forming nucleotides can occur consecutively (e.g., in a quadruplet along the sense strand nucleotide sequence). Alternatively, nucleotides of the antisense strand that form mismatched base pairs with the target CKAP5 RNA sequence can be interspersed by nucleotides that form matched base pairs with the target CKAP5 RNA sequence (e.g., for a DsiRNA possessing mismatch-forming nucleotides at positions 17, 19, 21 and 22, but not at positions 18 and 20, the mismatch-forming residues of antisense strand positions 21 and 22 are adjacent to one another, while the mismatch-forming residues of antisense strand positions 17 and 19 are interspersed by one nucleotide that forms a matched base pair with the corresponding residue of the target CKAP5 RNA sequence—similarly, the mismatch-forming residues of antisense strand positions 19 and 21 are also interspersed by one nucleotide that forms a matched base pair with the corresponding residue of the target CKAP5 RNA sequence). For example, four residues of the antisense strand (located within the mismatch-tolerant region of the antisense strand) that form mismatched base pairs with the corresponding target CKAP5 RNA sequence can occur with zero, one, two or three matched base pairs located between any two of these mismatch-forming base pairs.

The above DsiRNAmm and other dsRNA structures are described in order to exemplify certain structures of DsiRNAmm and dsRNA agents. Design of the above DsiRNAmm and dsRNA structures can be adapted to generate, e.g., DsiRNAmm forms of other DsiRNA structures shown infra. As exemplified above, dsRNAs can also be designed that possess single mismatches (or two, three or four mismatches) between the antisense strand of the dsRNA and a target sequence, yet optionally can retain perfect complementarity between sense and antisense strand sequences of a dsRNA.

It is further noted that the dsRNA agents exemplified infra can also possess insertion/deletion (in/del) structures within their double-stranded and/or target CKAP5 RNA-aligned structures. Accordingly, the dsRNAs of the invention can be designed to possess in/del variations in, e.g., antisense strand sequence as compared to target CKAP5 RNA sequence and/or antisense strand sequence as compared to sense strand sequence, with preferred location(s) for placement of such in/del nucleotides corresponding to those locations described above for positioning of mismatched and/or mismatch-forming base pairs.

It is also noted that the DsiRNAs of the instant invention can tolerate mismatches within the 3'-terminal region of the sense strand/5'-terminal region of the antisense strand, as this region is modeled to be processed by Dicer and liberated from the guide strand sequence that loads into RISC. Exemplary DsiRNA structures of the invention that harbor such mismatches include the following:

```
Target RNA Sequence:
5'- . . . XXXXXXXXXXXXXXXXXXXXHXXX . . . -3'

DsiRNA Sense Strand:
5'-XXXXXXXXXXXXXXXXXXXXXIXDD-3'

DsiRNA Antisense Strand:
3'-XXXXXXXXXXXXXXXXXXXXXXXJXXX-5'

Target RNA Sequence:
5'- . . . XXXXXXXXXXXXXXXXXXXXHXX . . . -3'

DsiRNA Sense Strand:
5'-XXXXXXXXXXXXXXXXXXXXXIDD-3'

DsiRNA Antisense Strand:
3'-XXXXXXXXXXXXXXXXXXXXXXXJXX-5'

Target RNA Sequence:
5'- . . . XXXXXXXXXXXXXXXXXXXXHX . . . -3'

DsiRNA Sense Strand:
5'-XXXXXXXXXXXXXXXXXXXXXID-3'

DsiRNA Antisense Strand:
3'-XXXXXXXXXXXXXXXXXXXXXXXJX-5'

Target RNA Sequence:
5'- . . . XXXXXXXXXXXXXXXXXXXXH . . . -3'

DsiRNA Sense Strand:
5'-XXXXXXXXXXXXXXXXXXXXXDI-3'

DsiRNA Antisense Strand:
3'-XXXXXXXXXXXXXXXXXXXXXXXJ-5'
``` wherein "X"=RNA, "D"=DNA and "I" and "J"=Nucleic acid residues (RNA, DNA or non-natural or modified nucleic acids) that do not base pair (hydrogen bond) with one another, yet optionally "J" is complementary to target RNA sequence nucleotide "H". Any of the residues of such agents can optionally be 2'-O-methyl RNA monomers—alternating positioning of 2'-O-methyl RNA monomers that commences from the 3'-terminal residue of the bottom (second) strand, as shown above—or any of the above-described methylation patterns—can also be used in the above DsiRNA agents. The above mismatches can also be combined within the DsiRNAs of the instant invention.

In the below structures, such mismatches are introduced within the asymmetric CKAP5-604 DsiRNA (newly-introduced mismatch residues are italicized):

CKAP5-604 25/27mer DsiRNA, mismatch position=19 of sense strand (from 5'-terminus)

```
5'-UUAAGUGAAUUUGGUUCCUAAAUca-3' (SEQ ID NO: 5763)
3'-GGAAUUCACUUAAACCAAGGUUUUAGU-5' (SEQ ID NO: 619)
```

Optionally, the mismatched 'U' residue of position 19 of the sense strand is alternatively 'C' or 'G'.
CKAP5-604 25/27mer DsiRNA, mismatch position=20 of sense strand (from 5'-terminus)

```
5'-UUAAGUGAAUUUGGUUCCAUAAUca-3' (SEQ ID NO: 5764)
3'-GGAAUUCACUUAAACCAAGGUUUUAGU-5' (SEQ ID NO: 619)
```

Optionally, the mismatched 'U' residue of position 20 of the sense strand is alternatively 'C' or 'G'.
CKAP5-604 25/27mer DsiRNA, mismatch position=21 of sense strand (from 5'-terminus)

```
5'-UUAAGUGAAUUUGGUUCCAAUAUca-3' (SEQ ID NO: 5765)
3'-GGAAUUCACUUAAACCAAGGUUUUAGU-5' (SEQ ID NO: 619)
```

Optionally, the mismatched 'U' residue of position 21 of the sense strand is alternatively 'G' or 'C'.
CKAP5-604 25/27mer DsiRNA, mismatch position=22 of sense strand (from 5'-terminus)

```
5'-UUAAGUGAAUUUGGUUCCAAAGUca-3' (SEQ ID NO: 5766)
3'-GGAAUUCACUUAAACCAAGGUUUUAGU-5' (SEQ ID NO: 619)
```

Optionally, the mismatched 'G' residue of position 22 of the sense strand is alternatively 'U' or 'C'.
CKAP5-604 25/27mer DsiRNA, mismatch position=23 of sense strand (from 5'-terminus)

```
5'-UUAAGUGAAUUUGGUUCCAAAAAca-3' (SEQ ID NO: 5767)
3'-GGAAUUCACUUAAACCAAGGUUUUAGU-5' (SEQ ID NO: 619)
```

Optionally, the mismatched 'A' residue of position 23 of the sense strand is alternatively 'C' or 'G'.

CKAP5-604 25/27mer DsiRNA, mismatch position=24 of sense strand (from 5'-terminus)

```
5'-UUAAGUGAAUUUGGUUCCAAAAUta-3' (SEQ ID NO: 5768)
3'-GGAAUUCACUUAAACCAAGGUUUUAGU-5' (SEQ ID NO: 619)
```

Optionally, the mismatched 't' residue of position 24 of the sense strand is alternatively 'a' or 'g'.
CKAP5-604 25/27mer DsiRNA, mismatch position=25 of sense strand (from 5'-terminus)

```
5'-UUAAGUGAAUUUGGUUCCAAAAUct-3' (SEQ ID NO: 5769)
3'-GGAAUUCACUUAAACCAAGGUUUUAGU-5' (SEQ ID NO: 619)
```

Optionally, the mismatched 't' residue of position 25 of the sense strand is alternatively 'c' or 'g'.
CKAP5-604 25/27mer DsiRNA, mismatch position=1 of antisense strand (from 5'-terminus)

```
5'-UUAAGUGAAUUUGGUUCCAAAAUca-3' (SEQ ID NO: 43)
3'-GGAAUUCACUUAAACCAAGGUUUUAGA-5' (SEQ ID NO: 5770)
```

Optionally, the mismatched 'A' residue of position 1 of the antisense strand is alternatively 'G' or 'C'.
CKAP5-604 25/27mer DsiRNA, mismatch position=2 of antisense strand (from 5'-terminus)

```
5'-UUAAGUGAAUUUGGUUCCAAAAUca-3' (SEQ ID NO: 43)
3'-GGAAUUCACUUAAACCAAGGUUUUAAU-5' (SEQ ID NO: 5711)
```

Optionally, the mismatched 'A' residue of position 2 of the antisense strand is alternatively 'U' or 'C'.
CKAP5-604 25/27mer DsiRNA, mismatch position=3 of antisense strand (from 5'-terminus)

```
5'-UUAAGUGAAUUUGGUUCCAAAAUca-3' (SEQ ID NO: 43)
3'-GGAAUUCACUUAAACCAAGGUUUUGGU-5' (SEQ ID NO: 5772)
```

Optionally, the mismatched 'U' residue of position 3 of the antisense strand is alternatively 'C' or 'G'.
CKAP5-604 25/27mer DsiRNA, mismatch position=4 of antisense strand (from 5'-terminus)

```
5'-UUAAGUGAAUUUGGUUCCAAAAUca-3' (SEQ ID NO: 43)
3'-GGAAUUCACUUAAACCAAGGUUUCAGU-5' (SEQ ID NO: 5773)
```

Optionally, the mismatched 'C' residue of position 4 of the antisense strand is alternatively 'A' or 'G'.
CKAP5-604 25/27mer DsiRNA, mismatch position=5 of antisense strand (from 5'-terminus)

```
5'-UUAAGUGAAUUUGGUUCCAAAAUca-3' (SEQ ID NO: 43)
3'-GGAAUUCACUUAAACCAAGGUUAUAGU-5' (SEQ ID NO: 5774)
```

Optionally, the mismatched 'A' residue of position 5 of the antisense strand is alternatively 'C' or 'G'.

CKAP5-604 25/27mer DsiRNA, mismatch position=6 of antisense strand (from 5'-terminus)

```
5'-UUAAGUGAAUUUGGUUCCAA^AAAUca-3'    (SEQ ID NO: 43)
3'-GGAAUUCACUUAAACCAAGGUU_AUUAGU-5'  (SEQ ID NO: 5775)
```

Optionally, the mismatched 'A' residue of position 6 of the antisense strand is alternatively 'C' or 'G'.

CKAP5-604 25/27mer DsiRNA, mismatch position=7 of antisense strand (from 5'-terminus)

```
5'-UUAAGUGAAUUUGGUUCC^AAAUca-3'      (SEQ ID NO: 43)
3'-GGAAUUCACUUAAACCAAGG_AUUUAGU-5'   (SEQ ID NO: 5776)
```

Optionally, the mismatched 'A' residue of position 7 of the antisense strand is alternatively 'C' or 'G'.

As another example, in the below structures, such mismatches are introduced within the asymmetric CKAP5-853 DsiRNA (newly-introduced mismatch residues are italicized): CKAP5-853 25/27mer DsiRNA, mismatch position=19 of sense strand (from 5'-terminus)

```
5'-CAACAAGAACUAGAAGCU^U AAUUgg-3'    (SEQ ID NO: 5777)
3'-GGGUUGUUCUUGAUCUUCGA_U UUAACC-5'  (SEQ ID NO: 627)
```

Optionally, the mismatched 'U' residue of position 19 of the sense strand is alternatively 'C' or 'G'.

CKAP5-853 25/27mer DsiRNA, mismatch position=20 of sense strand (from 5'-terminus)

```
5'-CAACAAGAACUAGAAGCUA^G AUUgg-3'    (SEQ ID NO: 5778)
3'-GGGUUGUUCUUGAUCUUCGAU_U UAACC-5'  (SEQ ID NO: 627)
```

Optionally, the mismatched 'G' residue of position 20 of the sense strand is alternatively 'C' or 'U'.

CKAP5-853 25/27mer DsiRNA, mismatch position=21 of sense strand (from 5'-terminus)

```
5'-CAACAAGAACUAGAAGCUAA^U UGgg-3'    (SEQ ID NO: 5779)
3'-GGGUUGUUCUUGAUCUUCGAUU_U AACC-5'  (SEQ ID NO: 627)
```

Optionally, the mismatched 'U' residue of position 21 of the sense strand is alternatively 'G' or 'C'.

CKAP5-853 25/27mer DsiRNA, mismatch position=22 of sense strand (from 5'-terminus)

```
5'-CAACAAGAACUAGAAGCUAAA^G gg-3'     (SEQ ID NO: 5780)
3'-GGGUUGUUCUUGAUCUUCGAUUU_A ACC-5'  (SEQ ID NO: 627)
```

Optionally, the mismatched 'G' residue of position 22 of the sense strand is alternatively 'A' or 'C'.

CKAP5-853 25/27mer DsiRNA, mismatch position=23 of sense strand (from 5'-terminus)

```
5'-CAACAAGAACUAGAAGCUAAAU^A GG-3'    (SEQ ID NO: 5781)
3'-GGGUUGUUCUUGAUCUUCGAUUUA_A CC-5'  (SEQ ID NO: 627)
```

Optionally, the mismatched 'A' residue of position 23 of the sense strand is alternatively 'C' or 'G'.

CKAP5-853 25/27mer DsiRNA, mismatch position=24 of sense strand (from 5'-terminus)

```
5'-CAACAAGAACUAGAAGCUAAAUU^t g-3'    (SEQ ID NO: 5782)
3'-GGGUUGUUCUUGAUCUUCGAUUUAA_G C-5'  (SEQ ID NO: 627)
```

Optionally, the mismatched 't' residue of position 24 of the sense strand is alternatively 'a' or 'c'.

CKAP5-853 25/27mer DsiRNA, mismatch position=25 of sense strand (from 5'-terminus)

```
5'-CAACAAGAACUAGAAGCUAAAUUg^a -3'    (SEQ ID NO: 5783)
3'-GGGUUGUUCUUGAUCUUCGAUUUAAC_C -5'  (SEQ ID NO: 627)
```

Optionally, the mismatched 'a' residue of position 25 of the sense strand is alternatively 't' or 'c'.

CKAP5-853 25/27mer DsiRNA, mismatch position=1 of antisense strand (from 5'-terminus)

```
5'-CAACAAGAACUAGAAGCUAAAUUg^g -3'    (SEQ ID NO: 51)
3'-GGGUUGUUCUUGAUCUUCGAUUUAAC_U -5'  (SEQ ID NO: 5784)
```

Optionally, the mismatched 'U' residue of position 1 of the antisense strand is alternatively 'A' or 'G'.

CKAP5-853 25/27mer DsiRNA, mismatch position=2 of antisense strand (from 5'-terminus)

```
5'-CAACAAGAACUAGAAGCUAAAUU^g g-3'    (SEQ ID NO: 51)
3'-GGGUUGUUCUUGAUCUUCGAUUUAA_A C-5'  (SEQ ID NO: 5785)
```

Optionally, the mismatched 'A' residue of position 2 of the antisense strand is alternatively 'U' or 'G'.

CKAP5-853 25/27mer DsiRNA, mismatch position=3 of antisense strand (from 5'-terminus)

```
5'-CAACAAGAACUAGAAGCUAAAU^U gg-3'    (SEQ ID NO: 51)
3'-GGGUUGUUCUUGAUCUUCGAUUUA_U CC-5'  (SEQ ID NO: 5786)
```

Optionally, the mismatched 'U' residue of position 3 of the antisense strand is alternatively 'C' or 'G'.

CKAP5-853 25/27mer DsiRNA, mismatch position=4 of antisense strand (from 5'-terminus)

```
5'-CAACAAGAACUAGAAGCUAAA^U Ugg-3'    (SEQ ID NO: 51)
3'-GGGUUGUUCUUGAUCUUCGAUUU_C ACC-5'  (SEQ ID NO: 5787)
```

Optionally, the mismatched 'C' residue of position 4 of the antisense strand is alternatively 'U' or 'G'.

CKAP5-853 25/27mer DsiRNA, mismatch position=5 of antisense strand (from 5'-terminus)

```
5'-CAACAAGAACUAGAAGCUAA^AUUgg-3'      (SEQ ID NO: 51)
3'-GGGUUGUUCUUGAUCUUCGAUU_AAACC-5'   (SEQ ID NO: 5788)
```

Optionally, the mismatched 'A' residue of position 5 of the antisense strand is alternatively 'C' or 'G'.

CKAP5-853 25/27mer DsiRNA, mismatch position=6 of antisense strand (from 5'-terminus)

```
5'-CAACAAGAACUAGAAGCUA^AAUUgg-3'      (SEQ ID NO: 51)
3'-GGGUUGUUCUUGAUCUUCGAU_CUAACC-5'   (SEQ ID NO: 5789)
```

Optionally, the mismatched 'C' residue of position 6 of the antisense strand is alternatively 'A' or 'G'.

CKAP5-853 25/27mer DsiRNA, mismatch position=7 of antisense strand (from 5'-terminus)

```
5'-CAACAAGAACUAGAAGCU^AAAUUgg-3'     (SEQ ID NO: 51)
3'-GGGUUGUUCUUGAUCUUCGA_AUUAACC-5'  (SEQ ID NO: 5790)
```

Optionally, the mismatched 'A' residue of position 7 of the antisense strand is alternatively 'C' or 'G'.

As an additional example, in the below structures, such mismatches are introduced within the asymmetric CKAP5-1358 DsiRNA (newly-introduced mismatch residues are italicized): CKAP5-1358 25/27mer DsiRNA, mismatch position=19 of sense strand (from 5'-terminus)

```
5'-CAGUAAUGGAUAAUAAAA^UUCCAac-3'    (SEQ ID NO: 5791)
3'-UCGUCAUUACCUAUUAUUUU_UAGGUUG-5'  (SEQ ID NO: 695)
```

Optionally, the mismatched 'U' residue of position 19 of the sense strand is alternatively 'C' or 'G'.

CKAP5-1358 25/27mer DsiRNA, mismatch position=20 of sense strand (from 5'-terminus)

```
5'-CAGUAAUGGAUAAUAAAAA^ACCAac-3'    (SEQ ID NO: 5792)
3'-UCGUCAUUACCUAUUAUUUU_AGGUUG-5'   (SEQ ID NO: 695)
```

Optionally, the mismatched 'A' residue of position 20 of the sense strand is alternatively 'C' or 'G'.

CKAP5-1358 25/27mer DsiRNA, mismatch position=21 of sense strand (from 5'-terminus)

```
5'-CAGUAAUGGAUAAUAAAAAU^ACAac-3'    (SEQ ID NO: 5793)
3'-UCGUCAUUACCUAUUAUUUUA_GGUUG-5'   (SEQ ID NO: 695)
```

Optionally, the mismatched 'A' residue of position 21 of the sense strand is alternatively 'U' or 'G'.

CKAP5-1358 25/27mer DsiRNA, mismatch position=22 of sense strand (from 5'-terminus)

```
5'-CAGUAAUGGAUAAUAAAAAUC^UAac-3'    (SEQ ID NO: 5794)
3'-UCGUCAUUACCUAUUAUUUUUAG_GUUG-5'  (SEQ ID NO: 695)
```

Optionally, the mismatched 'U' residue of position 22 of the sense strand is alternatively 'A' or 'G'.

CKAP5-1358 25/27mer DsiRNA, mismatch position=23 of sense strand (from 5'-terminus)

```
5'-CAGUAAUGGAUAAUAAAAAUCC^Uac-3'    (SEQ ID NO: 5795)
3'-UCGUCAUUACCUAUUAUUUUUAGG_UUG-5'  (SEQ ID NO: 695)
```

Optionally, the mismatched 'U' residue of position 23 of the sense strand is alternatively 'C' or 'G'.

CKAP5-1358 25/27mer DsiRNA, mismatch position=24 of sense strand (from 5'-terminus)

```
5'-CAGUAAUGGAUAAUAAAAAUCCA^gc-3'    (SEQ ID NO: 5796)
3'-UCGUCAUUACCUAUUAUUUUUAGGU_UG-5'  (SEQ ID NO: 695)
```

Optionally, the mismatched 'g' residue of position 24 of the sense strand is alternatively 't' or 'c'.

CKAP5-1358 25/27mer DsiRNA, mismatch position=25 of sense strand (from 5'-terminus)

```
5'-CAGUAAUGGAUAAUAAAAAUCCAa^-3'     (SEQ ID NO: 5797)
3'-UCGUCAUUACCUAUUAUUUUUAGGUU_G-5'  (SEQ ID NO: 695)
```

Optionally, the mismatched 'a' residue of position 25 of the sense strand is alternatively 't' or 'g'.

CKAP5-1358 25/27mer DsiRNA, mismatch position=1 of antisense strand (from 5'-terminus)

```
5'-CAGUAAUGGAUAAUAAAAAUCCAa^c-3'    (SEQ ID NO: 119)
3'-UCGUCAUUACCUAUUAUUUUUAGGUU_U-5'  (SEQ ID NO: 5798)
```

Optionally, the mismatched 'U' residue of position 1 of the antisense strand is alternatively 'A' or 'C'.

CKAP5-1358 25/27mer DsiRNA, mismatch position=2 of antisense strand (from 5'-terminus)

```
5'-CAGUAAUGGAUAAUAAAAAUCCA^ac-3'    (SEQ ID NO: 119)
3'-UCGUCAUUACCUAUUAUUUUUAGGU_CG-5'  (SEQ ID NO: 5799)
```

Optionally, the mismatched 'C' residue of position 2 of the antisense strand is alternatively 'A' or 'G'.

CKAP5-1358 25/27mer DsiRNA, mismatch position=3 of antisense strand (from 5'-terminus)

```
5'-CAGUAAUGGAUAAUAAAAAUCC^Aac-3'    (SEQ ID NO: 119)
3'-UCGUCAUUACCUAUUAUUUUUAGG_AUG-5'  (SEQ ID NO: 5800)
```

Optionally, the mismatched 'A' residue of position 3 of the antisense strand is alternatively 'C' or 'G'.

CKAP5-1358 25/27mer DsiRNA, mismatch position=4 of antisense strand (from 5'-terminus)

```
5'-CAGUAAUGGAUAAUAAAAAUC^CAac-3'  (SEQ ID NO: 119)
3'-UCGUCAUUACCUAUUAUUUUUAG_AUUG-5' (SEQ ID NO: 5801)
```

Optionally, the mismatched 'A' residue of position 4 of the antisense strand is alternatively 'U' or 'C'.
CKAP5-1358 25/27mer DsiRNA, mismatch position=5 of antisense strand (from 5'-terminus)

```
5'-CAGUAAUGGAUAAUAAAAAU^CCAac-3'  (SEQ ID NO: 119)
3'-UCGUCAUUACCUAUUAUUUUUA_UGUUG-5' (SEQ ID NO: 5802)
```

Optionally, the mismatched 'U' residue of position 5 of the antisense strand is alternatively 'A' or 'C'.
CKAP5-1358 25/27mer DsiRNA, mismatch position=6 of antisense strand (from 5'-terminus)

```
5'-CAGUAAUGGAUAAUAAAAA^UCCAac-3'  (SEQ ID NO: 119)
3'-UCGUCAUUACCUAUUAUUUU_UGGUUG-5' (SEQ ID NO: 5803)
```

Optionally, the mismatched 'U' residue of position 6 of the antisense strand is alternatively 'C' or 'G'.
CKAP5-1358 25/27mer DsiRNA, mismatch position=7 of antisense strand (from 5'-terminus)

```
5'-CAGUAAUGGAUAAUAAAA^AUCCAac-3'  (SEQ ID NO: 119)
3'-UCGUCAUUACCUAUUAUUU_UAGGUUG-5' (SEQ ID NO: 5804)
```

Optionally, the mismatched 'A' residue of position 7 of the antisense strand is alternatively 'C' or 'G'.

As a further example, in the below structures, such mismatches are introduced within the asymmetric CKAP5-2096 DsiRNA (newly-introduced mismatch residues are italicized): CKAP5-2096 25/27mer DsiRNA, mismatch position=19 of sense strand (from 5'-terminus)

```
5'-GAUGGAAAGAAACUAAUU^AUCAGgt-3'  (SEQ ID NO: 5805)
3'-ACCUACCUUUCUUUGAUUAA_AAGUCCA-5' (SEQ ID NO: 716)
```

Optionally, the mismatched 'A' residue of position 19 of the sense strand is alternatively 'C' or 'G'.
CKAP5-2096 25/27mer DsiRNA, mismatch position=20 of sense strand (from 5'-terminus)

```
5'-GAUGGAAAGAAACUAAUUU^ACAGgt-3'  (SEQ ID NO: 5806)
3'-ACCUACCUUUCUUUGAUUAAA_AGUCCA-5' (SEQ ID NO: 716)
```

Optionally, the mismatched 'A' residue of position 20 of the sense strand is alternatively 'C' or 'G'.
CKAP5-2096 25/27mer DsiRNA, mismatch position=21 of sense strand (from 5'-terminus)

```
5'-GAUGGAAAGAAACUAAUUUU^AAGgt-3'  (SEQ ID NO: 5807)
3'-ACCUACCUUUCUUUGAUUAAAA_GUCCA-5' (SEQ ID NO: 716)
```

Optionally, the mismatched 'A' residue of position 21 of the sense strand is alternatively 'U' or 'G'.
CKAP5-2096 25/27mer DsiRNA, mismatch position=22 of sense strand (from 5'-terminus)

```
5'-GAUGGAAAGAAACUAAUUUUC^Ggt-3'  (SEQ ID NO: 5808)
3'-ACCUACCUUUCUUUGAUUAAAAG_UCCA-5' (SEQ ID NO: 716)
```

Optionally, the mismatched 'G' residue of position 22 of the sense strand is alternatively 'U' or 'C'.
CKAP5-2096 25/27mer DsiRNA, mismatch position=23 of sense strand (from 5'-terminus)

```
5'-GAUGGAAAGAAACUAAUUUUCA^Agt-3'  (SEQ ID NO: 5809)
3'-ACCUACCUUUCUUUGAUUAAAAGU_CCA-5' (SEQ ID NO: 716)
```

Optionally, the mismatched 'A' residue of position 23 of the sense strand is alternatively 'U' or 'C'.
CKAP5-2096 25/27mer DsiRNA, mismatch position=24 of sense strand (from 5'-terminus)

```
5'-GAUGGAAAGAAACUAAUUUUCAG^t-3'  (SEQ ID NO: 5810)
3'-ACCUACCUUUCUUUGAUUAAAAGUC_CA-5' (SEQ ID NO: 716)
```

Optionally, the mismatched 't' residue of position 24 of the sense strand is alternatively 'a' or 'c'.
CKAP5-2096 25/27mer DsiRNA, mismatch position=25 of sense strand (from 5'-terminus)

```
5'-GAUGGAAAGAAACUAAUUUUCAGg^a-3'  (SEQ ID NO: 5811)
3'-ACCUACCUUUCUUUGAUUAAAAGUCC_A-5' (SEQ ID NO: 716)
```

Optionally, the mismatched 'a' residue of position 25 of the sense strand is alternatively 'c' or 'g'.
CKAP5-2096 25/27mer DsiRNA, mismatch position=1 of antisense strand (from 5'-terminus)

```
5'-GAUGGAAAGAAACUAAUUUUCAGg^t-3'  (SEQ ID NO: 140)
3'-ACCUACCUUUCUUUGAUUAAAAGUCC_U-5' (SEQ ID NO: 5812)
```

Optionally, the mismatched 'U' residue of position 1 of the antisense strand is alternatively 'G' or 'C'.
CKAP5-2096 25/27mer DsiRNA, mismatch position=2 of antisense strand (from 5'-terminus)

```
                                          (SEQ ID NO: 140)
5'-GAUGGAAAGAAACUAAUUUUCAG^gt-3'
                                          (SEQ ID NO: 5813)
3'-ACCUACCUUUCUUUGAUUAAAAGUC_A-5'
```

Optionally, the mismatched 'A' residue of position 2 of the antisense strand is alternatively 'U' or 'G'.

CKAP5-2096 25/27mer DsiRNA, mismatch position=3 of antisense strand (from 5'-terminus)

(SEQ ID NO: 140)
5'-GAUGGAAAGAAACUAAUUUUCA$^G$gt-3'

(SEQ ID NO: 5814)
3'-ACCUACCUUUCUUUGAUUAAAAGU$_U$CA-5'

Optionally, the mismatched 'U' residue of position 3 of the antisense strand is alternatively 'A' or 'G'.

CKAP5-2096 25/27mer DsiRNA, mismatch position=4 of antisense strand (from 5'-terminus)

(SEQ ID NO: 140)
5'-GAUGGAAAGAAACUAAUUUUC$^A$Ggt-3'

(SEQ ID NO: 5815)
3'-ACCUACCUUUCUUUGAUUAAAAG$_C$CCA-5'

Optionally, the mismatched 'C' residue of position 4 of the antisense strand is alternatively 'A' or 'G'.

CKAP5-2096 25/27mer DsiRNA, mismatch position=5 of antisense strand (from 5'-terminus)

(SEQ ID NO: 140)
5'-GAUGGAAAGAAACUAAUUUU$^C$AGgt-3'

(SEQ ID NO: 5816)
3'-ACCUACCUUUCUUUGAUUAAAA$_U$UCCA-5'

Optionally, the mismatched 'U' residue of position 5 of the antisense strand is alternatively 'A' or 'C'.

CKAP5-2096 25/27mer DsiRNA, mismatch position=6 of antisense strand (from 5'-terminus)

(SEQ ID NO: 140)
5'-GAUGGAAAGAAACUAAUUU$^U$CAGgt-3'

(SEQ ID NO: 5817)
3'-ACCUACCUUUCUUUGAUUAAA$_U$GUCCA-5'

Optionally, the mismatched 'U' residue of position 6 of the antisense strand is alternatively 'C' or 'G'.

CKAP5-2096 25/27mer DsiRNA, mismatch position=7 of antisense strand (from 5'-terminus)

(SEQ ID NO: 140)
5'-GAUGGAAAGAAACUAAUU$^U$UCAGgt-3'

(SEQ ID NO: 5818)
3'-ACCUACCUUUCUUUGAUUAA$_U$AGUCCA-5'

Optionally, the mismatched 'U' residue of position 7 of the antisense strand is alternatively 'C' or 'G'.

As another example, in the below structures, such mismatches are introduced within the asymmetric CKAP5-4056 DsiRNA (newly-introduced mismatch residues are italicized): CKAP5-4056 25/27mer DsiRNA, mismatch position=19 of sense strand (from 5'-terminus)

(SEQ ID NO: 5819)
5'-GGAUGUCAUUCGUAAAGA$^A$GUUCgt-3'

(SEQ ID NO: 840)
3'-UUCCUACAGUAAGCAUUUCU$_U$CAAGCA-5'

Optionally, the mismatched 'A' residue of position 19 of the sense strand is alternatively 'C' or 'G'.

CKAP5-4056 25/27mer DsiRNA, mismatch position=20 of sense strand (from 5'-terminus)

(SEQ ID NO: 5820)
5'-GGAUGUCAUUCGUAAAGAU$^U$UUCgt-3'

(SEQ ID NO: 840)
3'-UUCCUACAGUAAGCAUUUCUA$_C$AAGCA-5'

Optionally, the mismatched 'U' residue of position 20 of the sense strand is alternatively 'A' or 'C'.

CKAP5-4056 25/27mer DsiRNA, mismatch position=21 of sense strand (from 5'-terminus)

(SEQ ID NO: 5821)
5'-GGAUGUCAUUCGUAAAGAUG$^A$UCgt-3'

(SEQ ID NO: 840)
3'-UUCCUACAGUAAGCAUUUCUAC$_A$AGCA-5'

Optionally, the mismatched 'A' residue of position 21 of the sense strand is alternatively 'C' or 'G'.

CKAP5-4056 25/27mer DsiRNA, mismatch position=22 of sense strand (from 5'-terminus)

(SEQ ID NO: 5822)
5'-GGAUGUCAUUCGUAAAGAUGU$^G$Cgt-3'

(SEQ ID NO: 840)
3'-UUCCUACAGUAAGCAUUUCUACA$_A$GCA-5'

Optionally, the mismatched 'G' residue of position 22 of the sense strand is alternatively 'A' or 'C'.

CKAP5-4056 25/27mer DsiRNA, mismatch position=23 of sense strand (from 5'-terminus)

(SEQ ID NO: 5823)
5'-GGAUGUCAUUCGUAAAGAUGUU$^A$gt-3'

(SEQ ID NO: 840)
3'-UUCCUACAGUAAGCAUUUCUACAA$_G$CA-5'

Optionally, the mismatched 'A' residue of position 23 of the sense strand is alternatively 'U' or 'G'.

CKAP5-4056 25/27mer DsiRNA, mismatch position=24 of sense strand (from 5'-terminus)

(SEQ ID NO: 5824)
5'-GGAUGUCAUUCGUAAAGAUGUUC$^t$-3'

(SEQ ID NO: 840)
3'-UUCCUACAGUAAGCAUUUCUACAAG$_C$A-5'

Optionally, the mismatched 't' residue of position 24 of the sense strand is alternatively 'a' or 'c'.

CKAP5-4056 25/27mer DsiRNA, mismatch position=25 of sense strand (from 5'-terminus)

(SEQ ID NO: 5825)
5'-GGAUGUCAUUCGUAAAGAUGUUCg$^a$-3'

(SEQ ID NO: 840)
3'-UUCCUACAGUAAGCAUUUCUACAAGC$_A$-5'

Optionally, the mismatched 'a' residue of position 25 of the sense strand is alternatively 'c' or 'g'.

CKAP5-4056 25/27mer DsiRNA, mismatch position=1 of antisense strand (from 5'-terminus)

5'-GGAUGUCAUUCGUAAAGAUGUUC$^g$t-3' (SEQ ID NO: 264)

3'-UUCCUACAGUAAGCAUUUCUACAAGC$_U$-5' (SEQ ID NO: 5826)

Optionally, the mismatched 'U' residue of position 1 of the antisense strand is alternatively 'G' or 'C'.

CKAP5-4056 25/27mer DsiRNA, mismatch position=2 of antisense strand (from 5'-terminus)

5'-GGAUGUCAUUCGUAAAGAUGUUC$^g$t-3' (SEQ ID NO: 264)

3'-UUCCUACAGUAAGCAUUUCUACAAG$_A$A-5' (SEQ ID NO: 5827)

Optionally, the mismatched 'A' residue of position 2 of the antisense strand is alternatively 'U' or 'G'.

CKAP5-4056 25/27mer DsiRNA, mismatch position=3 of antisense strand (from 5'-terminus)

5'-GGAUGUCAUUCGUAAAGAUGUU$^C$gt-3' (SEQ ID NO: 264)

3'-UUCCUACAGUAAGCAUUUCUACAA$_U$CA-5' (SEQ ID NO: 5828)

Optionally, the mismatched 'U' residue of position 3 of the antisense strand is alternatively 'A' or 'C'.

CKAP5-4056 25/27mer DsiRNA, mismatch position=4 of antisense strand (from 5'-terminus)

5'-GGAUGUCAUUCGUAAAGAUGU$^U$Cgt-3' (SEQ ID NO: 264)

3'-UUCCUACAGUAAGCAUUUCUACA$_C$GCA-5' (SEQ ID NO: 5829)

Optionally, the mismatched 'C' residue of position 4 of the antisense strand is alternatively 'U' or 'G'.

CKAP5-4056 25/27mer DsiRNA, mismatch position=5 of antisense strand (from 5'-terminus)

5'-GGAUGUCAUUCGUAAAGAUG$^U$UCgt-3' (SEQ ID NO: 264)

3'-UUCCUACAGUAAGCAUUUCUAC$_U$AGCA-5' (SEQ ID NO: 5830)

Optionally, the mismatched 'U' residue of position 5 of the antisense strand is alternatively 'C' or 'G'.

CKAP5-4056 25/27mer DsiRNA, mismatch position=6 of antisense strand (from 5'-terminus)

5'-GGAUGUCAUUCGUAAAGAU$^G$UUCgt-3' (SEQ ID NO: 264)

3'-UUCCUACAGUAAGCAUUUCUA$_A$AGCA-5' (SEQ ID NO: 5831)

Optionally, the mismatched 'A' residue of position 6 of the antisense strand is alternatively 'U' or 'G'.

CKAP5-4056 25/27mer DsiRNA, mismatch position=7 of antisense strand (from 5'-terminus)

5'-GGAUGUCAUUCGUAAAGA$^U$GUUCgt-3' (SEQ ID NO: 264)

3'-UUCCUACAGUAAGCAUUUCU$_C$CAAGCA-5' (SEQ ID NO: 5832)

Optionally, the mismatched 'U' residue of position 7 of the antisense strand is alternatively 'C' or 'G'.

As an additional example, in the below structures, such mismatches are introduced within the asymmetric CKAP5-5741 DsiRNA (newly-introduced mismatch residues are italicized): CKAP5-5741 25/27mer DsiRNA, mismatch position=19 of sense strand (from 5'-terminus)

5'-ACAUUGAACCAUUUCUGA$^U$AAAUtc-3' (SEQ ID NO: 5833)

3'-ACUGUAACUUGGUAAAGACU$_U$UUUAAG-5' (SEQ ID NO: 988)

Optionally, the mismatched 'U' residue of position 19 of the sense strand is alternatively 'C' or 'G'.

CKAP5-5741 25/27mer DsiRNA, mismatch position=20 of sense strand (from 5'-terminus)

5'-ACAUUGAACCAUUUCUGAA$^U$AAUtc-3' (SEQ ID NO: 5834)

3'-ACUGUAACUUGGUAAAGACUU$_U$UUAAG-5' (SEQ ID NO: 988)

Optionally, the mismatched 'U' residue of position 20 of the sense strand is alternatively 'C' or 'G'.

CKAP5-5741 25/27mer DsiRNA, mismatch position=21 of sense strand (from 5'-terminus)

5'-ACAUUGAACCAUUUCUGAAA$^U$AUtc-3' (SEQ ID NO: 5835)

3'-ACUGUAACUUGGUAAAGACUUU$_U$UAAG-5' (SEQ ID NO: 988)

Optionally, the mismatched 'U' residue of position 21 of the sense strand is alternatively 'G' or 'C'.

CKAP5-5741 25/27mer DsiRNA, mismatch position=22 of sense strand (from 5'-terminus)

5'-ACAUUGAACCAUUUCUGAAAA$^G$Utc-3' (SEQ ID NO: 5836)

3'-ACUGUAACUUGGUAAAGACUUUU$_U$AAG-5' (SEQ ID NO: 988)

Optionally, the mismatched 'G' residue of position 22 of the sense strand is alternatively 'U' or 'C'.

CKAP5-5741 25/27mer DsiRNA, mismatch position=23 of sense strand (from 5'-terminus)

5'-ACAUUGAACCAUUUCUGAAAAA$^A$tc-3' (SEQ ID NO: 5837)

3'-ACUGUAACUUGGUAAAGACUUUUU$_A$AG-5' (SEQ ID NO: 988)

Optionally, the mismatched 'A' residue of position 23 of the sense strand is alternatively 'C' or 'G'.

CKAP5-5741 25/27mer DsiRNA, mismatch position=24 of sense strand (from 5'-terminus)

```
                                              (SEQ ID NO: 5838)
             5'-ACAUUGAACCAUUUCUGAAAAAU^gc-3'

(SEQ ID NO: 988)
             3'-ACUGUAACUUGGUAAAGACUUUUUA_AG-5'
```

Optionally, the mismatched 'g' residue of position 24 of the sense strand is alternatively 'a' or 'c'.

CKAP5-5741 25/27mer DsiRNA, mismatch position=25 of sense strand (from 5'-terminus)

```
                                              (SEQ ID NO: 5839)
             5'-ACAUUGAACCAUUUCUGAAAAAUt^a-3'

(SEQ ID NO: 988)
             3'-ACUGUAACUUGGUAAAGACUUUUUAA_G-5'
```

Optionally, the mismatched 'a' residue of position 25 of the sense strand is alternatively 't' or 'g'.

CKAP5-5741 25/27mer DsiRNA, mismatch position=1 of antisense strand (from 5'-terminus)

```
                                              (SEQ ID NO: 412)
             5'-ACAUUGAACCAUUUCUGAAAAAUt^c-3'

(SEQ ID NO: 5840)
             3'-ACUGUAACUUGGUAAAGACUUUUUAA_U-5'
```

Optionally, the mismatched 'U' residue of position 1 of the antisense strand is alternatively 'A' or 'C'.

CKAP5-5741 25/27mer DsiRNA, mismatch position=2 of antisense strand (from 5'-terminus)

```
                                              (SEQ ID NO: 412)
             5'-ACAUUGAACCAUUUCUGAAAAAU^tc-3'

(SEQ ID NO: 5841)
             3'-ACUGUAACUUGGUAAAGACUUUUUA_CG-5'
```

Optionally, the mismatched 'C' residue of position 2 of the antisense strand is alternatively 'U' or 'G'.

CKAP5-5741 25/27mer DsiRNA, mismatch position=3 of antisense strand (from 5'-terminus)

```
                                              (SEQ ID NO: 412)
             5'-ACAUUGAACCAUUUCUGAAAAA^Utc-3'

(SEQ ID NO: 5842)
             3'-ACUGUAACUUGGUAAAGACUUUU_UAG-5'
```

Optionally, the mismatched 'U' residue of position 3 of the antisense strand is alternatively 'C' or 'G'.

CKAP5-5741 25/27mer DsiRNA, mismatch position=4 of antisense strand (from 5'-terminus)

```
                                              (SEQ ID NO: 412)
             5'-ACAUUGAACCAUUUCUGAAAA^AUtc-3'

(SEQ ID NO: 5843)
             3'-ACUGUAACUUGGUAAAGACUUU_CAAG-5'
```

Optionally, the mismatched 'C' residue of position 4 of the antisense strand is alternatively 'A' or 'G'.

CKAP5-5741 25/27mer DsiRNA, mismatch position=5 of antisense strand (from 5'-terminus)

```
                                              (SEQ ID NO: 412)
             5'-ACAUUGAACCAUUUCUGAAA^AAUtc-3'

(SEQ ID NO: 5844)
             3'-ACUGUAACUUGGUAAAGACUUU_AUAAG-5'
```

Optionally, the mismatched 'A' residue of position 5 of the antisense strand is alternatively 'C' or 'G'.

CKAP5-5741 25/27mer DsiRNA, mismatch position=6 of antisense strand (from 5'-terminus)

```
                                              (SEQ ID NO: 412)
             5'-ACAUUGAACCAUUUCUGAA^AAUtc-3'

(SEQ ID NO: 5845)
             3'-ACUGUAACUUGGUAAAGACUU_AUUAAG-5'
```

Optionally, the mismatched 'A' residue of position 6 of the antisense strand is alternatively 'C' or 'G'.

CKAP5-5741 25/27mer DsiRNA, mismatch position=7 of antisense strand (from 5'-terminus)

```
                                              (SEQ ID NO: 412)
             5'-ACAUUGAACCAUUUCUGA^AAAUtc-3'

(SEQ ID NO: 5846)
             3'-ACUGUAACUUGGUAAAGACU_AUUUAAG-5'
```

Optionally, the mismatched 'A' residue of position 7 of the antisense strand is alternatively 'C' or 'G'.

For the above oligonucleotide strand sequences, it is contemplated that the sense strand sequence of one depicted duplex can be combined with an antisense strand of another depicted duplex, thereby forming a distinct duplex—in certain instances, such duplexes contain a mismatched residue with respect to the CKAP5 target transcript sequence, while such sense and antisense strand sequences do not present a mismatch at this residue with respect to one another (e.g., duplexes comprising SEQ ID NOs: 5777 and 5790; SEQ ID NOs: 5778 and 5789; SEQ ID NOs: 5779 and 5788, etc., are contemplated as exemplary of such duplexes).

As noted above, introduction of such mismatches can be performed upon any of the DsiRNAs described herein.

The mismatches of such DsiRNA structures can be combined to produce a DsiRNA possessing, e.g., two, three or even four mismatches within the 3'-terminal four nucleotides of the sense strand/5'-terminal four nucleotides of the antisense strand.

Indeed, in view of the flexibility of sequences which can be incorporated into DsiRNAs at the 3'-terminal residues of the sense strand/5'-terminal residues of the antisense strand, in certain embodiments, the sequence requirements of an asymmetric DsiRNA of the instant invention can be represented as the following (minimalist) structure (shown for an exemplary CKAP5-604 DsiRNA sequence):

```
                                              (SEQ ID NO: 5847)
             5'-UUAAGUGAAUUUGGUUCCAAAXXX[X]_n-3'

(SEQ ID NO: 5848)
             3'-GGAAUUCACUUAAACCAAGGUXXXXX[X]_n-5'
``` where n=1 to 5, 1 to 10, 1 to 20, 1 to 30, 1 to 50, or 1 to 80 or more.

```
CKAP5-604 Target:
                                    (SEQ ID NO: 5849)
5'-CCTTAAGTGAATTTGGTTCCAXXXXXX-3'
```

The CKAP5 target site may also be a site which is targeted by one or more of several oligonucleotides whose complementary target sites overlap with a stated target site. For example, for an exemplary CKAP5-604 DsiRNA, it is noted that certain DsiRNAs targeting overlapping and only slightly offset CKAP5 sequences can exhibit activity levels similar to that of CKAP5-604 (specifically, CKAP5-600 to CKAP5-606 showed such an effect during primary screening. Thus, in certain embodiments, a designated target sequence region can be effectively targeted by a series of DsiRNAs possessing largely overlapping sequences. (E.g., if considering DsiRNAs surrounding the CKAP5-604 site, a more encompassing CKAP5 target sequence might be recited as, e.g., 5'-AAAGCCTTAAGTGAATTTGGTTC-CAAAATCATC-3' (SEQ ID NO: 5850), wherein any given DsiRNA (e.g., a DsiRNA selected from CKAP5-600 to CKAP5-606) only targets a sub-sequence within such a sequence region, yet the entire sequence can be considered a viable target for such a series of DsiRNAs).

Additionally and/or alternatively, mismatches within the 3'-terminal four to seven nucleotides of the sense strand/5'-terminal four to seven nucleotides of the antisense strand can be combined with mismatches positioned at other mismatch-tolerant positions, as described above.

In view of the present identification of the above-described Dicer substrate agents (DsiRNAs) as inhibitors of CKAP5 levels via targeting of specific CKAP5 sequences, it is also recognized that dsRNAs having structures similar to those described herein can also be synthesized which target other sequences within the CKAP5 sequence of NM_001008938.3, NM_014756.3 or NM_001165989.1, or within variants thereof (e.g., target sequences possessing 80% identity, 90% identity, 95% identity, 96% identity, 97% identity, 98% identity, 99% or more identity to a sequence of NM_001008938.3, NM_014756.3 and/or NM_001165989.1).

Anti-CKAP5 DsiRNA Design/Synthesis

It has been found empirically that longer dsRNA species of from 25 to 35 nucleotides (DsiRNAs) and especially from 25 to 30 nucleotides give unexpectedly effective results in terms of potency and duration of action, as compared to 19-23mer siRNA agents. Without wishing to be bound by the underlying theory of the dsRNA processing mechanism, it is thought that the longer dsRNA species serve as a substrate for the Dicer enzyme in the cytoplasm of a cell. In addition to cleaving the dsRNA of the invention into shorter segments, Dicer is thought to facilitate the incorporation of a single-stranded cleavage product derived from the cleaved dsRNA into the RISC complex that is responsible for the destruction of the cytoplasmic RNA (e.g., CKAP5 RNA) of or derived from the target gene, CKAP5 (or other gene associated with a CKAP5-associated disease or disorder). Prior studies (Rossi et al., U.S. Patent Application No. 2007/0265220) have shown that the cleavability of a dsRNA species (specifically, a DsiRNA agent) by Dicer corresponds with increased potency and duration of action of the dsRNA species.

Certain preferred anti-CKAP5 DsiRNA agents were selected from a pre-screened population. Design of DsiR-NAs can optionally involve use of predictive scoring algorithms that perform in silico assessments of the projected activity/efficacy of a number of possible DsiRNA agents spanning a region of sequence. Information regarding the design of such scoring algorithms can be found, e.g., in Gong et al. (*BMC Bioinformatics* 2006, 7:516), though more recent "v3" and "v4" algorithms represent theoretically improved algorithms relative to siRNA scoring algorithms previously available in the art. (E.g., the "v3" and "v4" scoring algorithms are machine learning algorithms that are not reliant upon any biases in human sequence. In addition, the "v3" and "v4" algorithms derive from data sets that are many-fold larger than that from which an older "v2" algorithm such as that described in Gong et al. derives.)

The first and second oligonucleotides of the DsiRNA agents of the instant invention are not required to be completely complementary. In fact, in one embodiment, the 3'-terminus of the sense strand contains one or more mismatches. In one aspect, two mismatches are incorporated at the 3' terminus of the sense strand. In another embodiment, the DsiRNA of the invention is a double stranded RNA molecule containing two RNA oligonucleotides each of which is 27 nucleotides in length and, when annealed to each other, have blunt ends and a two nucleotide mismatch on the 3'-terminus of the sense strand (the 5'-terminus of the antisense strand). The use of mismatches or decreased thermodynamic stability (specifically at the 3'-sense/5'-antisense position) has been proposed to facilitate or favor entry of the antisense strand into RISC (Schwarz et al., 2003, *Cell* 115: 199-208; Khvorova et al., 2003, *Cell* 115: 209-216), presumably by affecting some rate-limiting unwinding steps that occur with entry of the siRNA into RISC. Thus, terminal base composition has been included in design algorithms for selecting active 21mer siRNA duplexes (Ui-Tei et al., 2004, *Nucleic Acids Res* 32: 936-948; Reynolds et al., 2004, *Nat Biotechnol* 22: 326-330). With Dicer cleavage of the dsRNA of this embodiment, the small end-terminal sequence which contains the mismatches will either be left unpaired with the antisense strand (become part of a 3'-overhang) or be cleaved entirely off the final 21-mer siRNA. These "mismatches", therefore, do not persist as mismatches in the final RNA component of RISC. The finding that base mismatches or destabilization of segments at the 3'-end of the sense strand of Dicer substrate improved the potency of synthetic duplexes in RNAi, presumably by facilitating processing by Dicer, was a surprising finding of past works describing the design and use of 25-30mer dsRNAs (also termed "DsiRNAs" herein; Rossi et al., U.S. Patent Application Nos. 2005/0277610, 2005/0244858 and 2007/0265220).

Modification of Anti-CKAP5 dsRNAs

One major factor that inhibits the effect of double stranded RNAs ("dsRNAs") is the degradation of dsRNAs (e.g., siRNAs and DsiRNAs) by nucleases. A 3'-exonuclease is the primary nuclease activity present in serum and modification of the 3'-ends of antisense DNA oligonucleotides is crucial to prevent degradation (Eder et al., 1991, *Antisense Res Dev,* 1: 141-151). An RNase-T family nuclease has been identified called ERI-1 which has 3' to 5' exonuclease activity that is involved in regulation and degradation of siRNAs (Kennedy et al., 2004, *Nature* 427: 645-649; Hong et al., 2005, *Biochem J,* 390: 675-679). This gene is also known as Thex 1 (NM_02067) in mice or THEX1 (NM_153332) in humans and is involved in degradation of histone mRNA; it also mediates degradation of 3'-overhangs in siRNAs, but does not degrade duplex RNA (Yang et al., 2006, *J Biol Chem,* 281: 30447-30454). It is therefore reasonable to expect that 3'-end-stabilization of dsRNAs, including the DsiRNAs of the instant invention, will improve stability.

XRN1 (NM_019001) is a 5' to 3' exonuclease that resides in P-bodies and has been implicated in degradation of mRNA targeted by miRNA (Rehwinkel et al., 2005, RNA 11: 1640-1647) and may also be responsible for completing degradation initiated by internal cleavage as directed by a siRNA. XRN2 (NM_012255) is a distinct 5' to 3' exonuclease that is involved in nuclear RNA processing.

RNase A is a major endonuclease activity in mammals that degrades RNAs. It is specific for ssRNA and cleaves at the 3'-end of pyrimidine bases. SiRNA degradation products consistent with RNase A cleavage can be detected by mass spectrometry after incubation in serum (Turner et al., 2007, Mol Biosyst 3: 43-50). The 3'-overhangs enhance the susceptibility of siRNAs to RNase degradation. Depletion of RNase A from serum reduces degradation of siRNAs; this degradation does show some sequence preference and is worse for sequences having poly A/U sequence on the ends (Haupenthal et al., 2006 Biochem Pharmacol 71: 702-710). This suggests the possibility that lower stability regions of the duplex may "breathe" and offer transient single-stranded species available for degradation by RNase A. RNase A inhibitors can be added to serum and improve siRNA longevity and potency (Haupenthal et al., 2007, Int J. Cancer 121: 206-210).

In 21mers, phosphorothioate or boranophosphate modifications directly stabilize the internucleoside phosphate linkage. Boranophosphate modified RNAs are highly nuclease resistant, potent as silencing agents, and are relatively non-toxic. Boranophosphate modified RNAs cannot be manufactured using standard chemical synthesis methods and instead are made by in vitro transcription (IVT) (Hall et al., 2004, Nucleic Acids Res 32: 5991-6000; Hall et al., 2006, Nucleic Acids Res 34: 2773-2781). Phosphorothioate (PS) modifications can be easily placed in the RNA duplex at any desired position and can be made using standard chemical synthesis methods. The PS modification shows dose-dependent toxicity, so most investigators have recommended limited incorporation in siRNAs, favoring the 3'-ends where protection from nucleases is most important (Harborth et al., 2003, Antisense Nucleic Acid Drug Dev 13: 83-105; Chiu and Rana, 2003, Mol Cell 10: 549-561; Braasch et al., 2003, Biochemistry 42: 7967-7975; Amarzguioui et al., 2003, Nucleic Acids Research 31: 589-595). More extensive PS modification can be compatible with potent RNAi activity; however, use of sugar modifications (such as 2'-O-methyl RNA) may be superior (Choung et al., 2006, Biochem Biophys Res Commun 342: 919-927).

A variety of substitutions can be placed at the 2'-position of the ribose which generally increases duplex stability ($T_m$) and can greatly improve nuclease resistance. 2'-O-methyl RNA is a naturally occurring modification found in mammalian ribosomal RNAs and transfer RNAs. 2'-O-methyl modification in siRNAs is known, but the precise position of modified bases within the duplex is important to retain potency and complete substitution of 2'-O-methyl RNA for RNA will inactivate the siRNA. For example, a pattern that employs alternating 2'-O-methyl bases can have potency equivalent to unmodified RNA and is quite stable in serum (Choung et al., 2006, Biochem Biophys Res Commun 342: 919-927; Czauderna et al., 2003, Nucleic Acids Research 31: 2705-2716).

The 2'-fluoro (2'-F) modification is also compatible with dsRNA (e.g., siRNA and DsiRNA) function; it is most commonly placed at pyrimidine sites (due to reagent cost and availability) and can be combined with 2'-O-methyl modification at purine positions; 2'-F purines are available and can also be used. Heavily modified duplexes of this kind can be potent triggers of RNAi in vitro (Allerson et al., 2005, J Med Chem 48: 901-904; Prakash et al., 2005, J Med Chem 48: 4247-4253; Kraynack and Baker, 2006, RNA 12: 163-176) and can improve performance and extend duration of action when used in vivo (Morrissey et al., 2005, Hepatology 41: 1349-1356; Morrissey et al., 2005, Nat Biotechnol 23: 1002-1007). A highly potent, nuclease stable, blunt 19mer duplex containing alternative 2'-F and 2'-O-Me bases is taught by Allerson. In this design, alternating 2'-O-Me residues are positioned in an identical pattern to that employed by Czauderna, however the remaining RNA residues are converted to 2'-F modified bases. A highly potent, nuclease resistant siRNA employed by Morrissey employed a highly potent, nuclease resistant siRNA in vivo. In addition to 2'-O-Me RNA and 2'-F RNA, this duplex includes DNA, RNA, inverted abasic residues, and a 3'-terminal PS internucleoside linkage. While extensive modification has certain benefits, more limited modification of the duplex can also improve in vivo performance and is both simpler and less costly to manufacture. Soutschek et al. (2004, Nature 432: 173-178) employed a duplex in vivo and was mostly RNA with two 2'-O-Me RNA bases and limited 3'-terminal PS internucleoside linkages.

Locked nucleic acids (LNAs) are a different class of 2'-modification that can be used to stabilize dsRNA (e.g., siRNA and DsiRNA). Patterns of LNA incorporation that retain potency are more restricted than 2'-O-methyl or 2'-F bases, so limited modification is preferred (Braasch et al., 2003, Biochemistry 42: 7967-7975; Grunweller et al., 2003, Nucleic Acids Res 31: 3185-3193; Elmen et al., 2005, Nucleic Acids Res 33: 439-447). Even with limited incorporation, the use of LNA modifications can improve dsRNA performance in vivo and may also alter or improve off target effect profiles (Mook et al., 2007, Mol Cancer Ther 6: 833-843).

Synthetic nucleic acids introduced into cells or live animals can be recognized as "foreign" and trigger an immune response. Immune stimulation constitutes a major class of off-target effects which can dramatically change experimental results and even lead to cell death. The innate immune system includes a collection of receptor molecules that specifically interact with DNA and RNA that mediate these responses, some of which are located in the cytoplasm and some of which reside in endosomes (Marques and Williams, 2005, Nat Biotechnol 23: 1399-1405; Schlee et al., 2006, Mol Ther 14: 463-470). Delivery of siRNAs by cationic lipids or liposomes exposes the siRNA to both cytoplasmic and endosomal compartments, maximizing the risk for triggering a type 1 interferon (IFN) response both in vitro and in vivo (Morrissey et al., 2005, Nat Biotechnol 23: 1002-1007; Sioud and Sorensen, 2003, Biochem Biophys Res Commun 312: 1220-1225; Sioud, 2005, J Mol Biol 348: 1079-1090; Ma et al., 2005, Biochem Biophys Res Commun 330: 755-759). RNAs transcribed within the cell are less immunogenic (Robbins et al., 2006, Nat Biotechnol 24: 566-571) and synthetic RNAs that are immunogenic when delivered using lipid-based methods can evade immune stimulation when introduced unto cells by mechanical means, even in vivo (Heidel et al., 2004, Nat Biotechnol 22: 1579-1582). However, lipid based delivery methods are convenient, effective, and widely used. Some general strategy to prevent immune responses is needed, especially for in vivo application where all cell types are present and the risk of generating an immune response is highest. Use of chemically modified RNAs may solve most or even all of these problems.

In certain embodiments, modifications can be included in the anti-CKAP5 dsRNA agents of the present invention so long as the modification does not prevent the dsRNA agent from possessing CKAP5 inhibitory activity. In one embodiment, one or more modifications are made that enhance Dicer processing of the DsiRNA agent (an assay for determining Dicer processing of a DsiRNA is described elsewhere herein). In a second embodiment, one or more modifications are made that result in more effective CKAP5 inhibition (as described herein, CKAP5 inhibition/CKAP5 inhibitory activity of a dsRNA can be assayed via art-recognized methods for determining RNA levels, or for determining CKAP5 polypeptide levels, should such levels be assessed in lieu of or in addition to assessment of, e.g., CKAP5 mRNA levels). In a third embodiment, one or more modifications are made that support greater CKAP5 inhibitory activity (means of determining CKAP5 inhibitory activity are described supra). In a fourth embodiment, one or more modifications are made that result in greater potency of CKAP5 inhibitory activity per each dsRNA agent molecule to be delivered to the cell (potency of CKAP5 inhibitory activity is described supra). Modifications can be incorporated in the 3'-terminal region, the 5'-terminal region, in both the 3'-terminal and 5'-terminal region or in some instances in various positions within the sequence. With the restrictions noted above in mind, numbers and combinations of modifications can be incorporated into the dsRNA agent. Where multiple modifications are present, they may be the same or different. Modifications to bases, sugar moieties, the phosphate backbone, and their combinations are contemplated. Either 5'-terminus can be phosphorylated.

Examples of modifications contemplated for the phosphate backbone include phosphonates, including methylphosphonate, phosphorothioate, and phosphotriester modifications such as alkylphosphotriesters, and the like. Examples of modifications contemplated for the sugar moiety include 2'-alkyl pyrimidine, such as 2'-O-methyl, 2'-fluoro, amino, and deoxy modifications and the like (see, e.g., Amarzguioui et al., 2003, *Nucleic Acids Research* 31: 589-595). Examples of modifications contemplated for the base groups include abasic sugars, 2-O-alkyl modified pyrimidines, 4-thiouracil, 5-bromouracil, 5-iodouracil, and 5-(3-aminoallyl)-uracil and the like. Locked nucleic acids, or LNA's, could also be incorporated. Many other modifications are known and can be used so long as the above criteria are satisfied. Examples of modifications are also disclosed in U.S. Pat. Nos. 5,684,143, 5,858,988 and 6,291,438 and in U.S. published patent application No. 2004/0203145 A1. Other modifications are disclosed in Herdewijn (2000, *Antisense Nucleic Acid Drug Dev* 10: 297-310), Eckstein (2000, *Antisense Nucleic Acid Drug Dev* 10: 117-21), Rusckowski et al. (2000, *Antisense Nucleic Acid Drug Dev* 10: 333-345), Stein et al. (2001, *Antisense Nucleic Acid Drug Dev* 11: 317-25); Vorobjev et al. (2001, *Antisense Nucleic Acid Drug Dev* 11: 77-85).

One or more modifications contemplated can be incorporated into either strand. The placement of the modifications in the dsRNA agent can greatly affect the characteristics of the dsRNA agent, including conferring greater potency and stability, reducing toxicity, enhance Dicer processing, and minimizing an immune response. In one embodiment, the antisense strand or the sense strand or both strands have one or more 2'-O-methyl modified nucleotides. In another embodiment, the antisense strand contains 2'-O-methyl modified nucleotides. In another embodiment, the antisense stand contains a 3' overhang that is comprised of 2'-O-methyl modified nucleotides. The antisense strand could also include additional 2'-O-methyl modified nucleotides.

In certain embodiments, the anti-CKAP5 DsiRNA agent of the invention has several properties which enhance its processing by Dicer. According to such embodiments, the DsiRNA agent has a length sufficient such that it is processed by Dicer to produce an siRNA and at least one of the following properties: (i) the DsiRNA agent is asymmetric, e.g., has a 3' overhang on the sense strand and (ii) the DsiRNA agent has a modified 3' end on the antisense strand to direct orientation of Dicer binding and processing of the dsRNA to an active siRNA. According to these embodiments, the longest strand in the DsiRNA agent comprises 25-30 nucleotides. In one embodiment, the sense strand comprises 25-30 nucleotides and the antisense strand comprises 25-28 nucleotides. Thus, the resulting dsRNA has an overhang on the 3' end of the sense strand. The overhang is 1-4 nucleotides, such as 2 nucleotides. The antisense strand may also have a 5' phosphate.

In certain embodiments, the sense strand of a DsiRNA agent is modified for Dicer processing by suitable modifiers located at the 3' end of the sense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the sense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the sense strand in place of two ribonucleotides forming a blunt end of the duplex on the 5' end of the antisense strand and the 3' end of the sense strand, and a two-nucleotide RNA overhang is located on the 3'-end of the antisense strand. This is an asymmetric composition with DNA on the blunt end and RNA bases on the overhanging end.

In certain other embodiments, the antisense strand of a DsiRNA agent is modified for Dicer processing by suitable modifiers located at the 3' end of the antisense strand, i.e., the DsiRNA agent is designed to direct orientation of Dicer binding and processing. Suitable modifiers include nucleotides such as deoxyribonucleotides, dideoxyribonucleotides, acyclonucleotides and the like and sterically hindered molecules, such as fluorescent molecules and the like. Acyclonucleotides substitute a 2-hydroxyethoxymethyl group for the 2'-deoxyribofuranosyl sugar normally present in dNMPs. Other nucleotide modifiers could include 3'-deoxyadenosine (cordycepin), 3'-azido-3'-deoxythymidine (AZT), 2',3'-dideoxyinosine (ddI), 2',3'-dideoxy-3'-thiacytidine (3TC), 2',3'-didehydro-2',3'-dideoxythymidine (d4T) and the monophosphate nucleotides of 3'-azido-3'-deoxythymidine (AZT), 2',3'-dideoxy-3'-thiacytidine (3TC) and 2',3'-didehydro-2',3'-dideoxythymidine (d4T). In one embodiment, deoxynucleotides are used as the modifiers. When nucleotide modifiers are utilized, 1-3 nucleotide modifiers, or 2 nucleotide modifiers are substituted for the ribonucleotides on the 3' end of the antisense strand. When sterically hindered molecules are utilized, they are attached to the ribonucleotide at the 3' end of the antisense strand. Thus, the length of the strand does not change with the incorporation of the modifiers. In another embodiment, the invention contemplates substituting two DNA bases in the dsRNA to direct the orientation of Dicer processing. In a further invention, two terminal DNA bases are located on the 3' end of the antisense strand in place of two ribonucleotides forming a blunt end of the duplex on the 5' end of the sense strand and the 3' end of the antisense strand, and a two-nucleotide RNA overhang is located on the 3'-end of the sense strand. This is also an asymmetric composition with DNA on the blunt end and RNA bases on the overhanging end.

The sense and antisense strands anneal under biological conditions, such as the conditions found in the cytoplasm of a cell. In addition, a region of one of the sequences, particularly of the antisense strand, of the dsRNA has a sequence length of at least 19 nucleotides, wherein these nucleotides are adjacent to the 3' end of antisense strand and are sufficiently complementary to a nucleotide sequence of the target CKAP5 RNA.

Additionally, the DsiRNA agent structure can be optimized to ensure that the oligonucleotide segment generated from Dicer's cleavage will be the portion of the oligonucleotide that is most effective in inhibiting gene expression. For example, in one embodiment of the invention, a 27-bp oligonucleotide of the DsiRNA agent structure is synthesized wherein the anticipated 21 to 22-bp segment that will inhibit gene expression is located on the 3'-end of the antisense strand. The remaining bases located on the 5'-end of the antisense strand will be cleaved by Dicer and will be discarded. This cleaved portion can be homologous (i.e., based on the sequence of the target sequence) or non-homologous and added to extend the nucleic acid strand.

US 2007/0265220 discloses that 27mer DsiRNAs show improved stability in serum over comparable 21mer siRNA compositions, even absent chemical modification. Modifications of DsiRNA agents, such as inclusion of 2'-O-methyl RNA in the antisense strand, in patterns such as detailed above, when coupled with addition of a 5' Phosphate, can improve stability of DsiRNA agents. Addition of 5'-phosphate to all strands in synthetic RNA duplexes may be an inexpensive and physiological method to confer some limited degree of nuclease stability.

The chemical modification patterns of the dsRNA agents of the instant invention are designed to enhance the efficacy of such agents. Accordingly, such modifications are designed to avoid reducing potency of dsRNA agents; to avoid interfering with Dicer processing of DsiRNA agents; to improve stability in biological fluids (reduce nuclease sensitivity) of dsRNA agents; or to block or evade detection by the innate immune system. Such modifications are also designed to avoid being toxic and to avoid increasing the cost or impact the ease of manufacturing the instant dsRNA agents of the invention.

In certain embodiments of the present invention, an anti-CKAP5 DsiRNA agent has one or more of the following properties: (i) the DsiRNA agent is asymmetric, e.g., has a 3' overhang on the antisense strand and (ii) the DsiRNA agent has a modified 3' end on the sense strand to direct orientation of Dicer binding and processing of the dsRNA to an active siRNA. According to this embodiment, the longest strand in the dsRNA comprises 25-35 nucleotides (e.g., 25, 26, 27, 28, 29, 30, 31, 32, 33, 34 or 35 nucleotides). In certain such embodiments, the DsiRNA agent is asymmetric such that the sense strand comprises 25-34 nucleotides and the 3' end of the sense strand forms a blunt end with the 5' end of the antisense strand while the antisense strand comprises 26-35 nucleotides and forms an overhang on the 3' end of the antisense strand. In one embodiment, the DsiRNA agent is asymmetric such that the sense strand comprises 25-28 nucleotides and the antisense strand comprises 25-30 nucleotides. Thus, the resulting dsRNA has an overhang on the 3' end of the antisense strand. The overhang is 1-4 nucleotides, for example 2 nucleotides. The sense strand may also have a 5' phosphate.

The DsiRNA agent can also have one or more of the following additional properties: (a) the antisense strand has a right shift from the typical 21mer (e.g., the DsiRNA comprises a length of antisense strand nucleotides that extends to the 5' of a projected Dicer cleavage site within the DsiRNA, with such antisense strand nucleotides base paired with corresponding nucleotides of the sense strand extending 3' of a projected Dicer cleavage site in the sense strand), (b) the strands may not be completely complementary, i.e., the strands may contain simple mismatched base pairs (in certain embodiments, the DsiRNAs of the invention possess 1, 2, 3, 4 or even 5 or more mismatched base pairs, provided that CKAP5 inhibitory activity of the DsiRNA possessing mismatched base pairs is retained at sufficient levels (e.g., retains at least 50% CKAP5 inhibitory activity or more, at least 60% CKAP5 inhibitory activity or more, at least 70% CKAP5 inhibitory activity or more, at least 80% CKAP5 inhibitory activity or more, at least 90% CKAP5 inhibitory activity or more or at least 95% CKAP5 inhibitory activity or more as compared to a corresponding DsiRNA not possessing mismatched base pairs. In certain embodiments, mismatched base pairs exist between the antisense and sense strands of a DsiRNA. In some embodiments, mismatched base pairs exist (or are predicted to exist) between the antisense strand and the target RNA. In certain embodiments, the presence of a mismatched base pair(s) between an antisense strand residue and a corresponding residue within the target RNA that is located 3' in the target RNA sequence of a projected Ago2 cleavage site retains and may even enhance CKAP5 inhibitory activity of a DsiRNA of the invention) and (c) base modifications such as locked nucleic acid(s) may be included in the 5' end of the sense strand. A "typical" 21mer siRNA is designed using conventional techniques. In one technique, a variety of sites are commonly tested in parallel or pools containing several distinct siRNA duplexes specific to the same target with the hope that one of the reagents will be effective (Ji et al., 2003, *FEBS Lett* 552: 247-252). Other techniques use design rules and algorithms to increase the likelihood of obtaining active RNAi effector molecules (Schwarz et al., 2003, *Cell* 115: 199-208; Khvorova et al., 2003, *Cell* 115: 209-216; Ui-Tei et al., 2004, *Nucleic Acids Res* 32: 936-948; Reynolds et al., 2004, *Nat Biotechnol* 22: 326-330; Krol et al., 2004, *J Biol Chem* 279: 42230-42239; Yuan et al., 2004, *Nucl Acids Res* 32(Webserver issue): W130-134; Boese et al., 2005, *Methods Enzymol* 392: 73-96). High throughput selection of siRNA has also been developed (U.S. published patent application No. 2005/0042641 A1). Potential target sites can also be analyzed by secondary structure predictions (Heale et al., 2005, *Nucleic Acids Res* 33(3): e30). This 21mer is then used to design a right shift to include 3-9 additional nucleotides on the 5' end of the 21mer. The sequence of these additional nucleotides is not restricted. In one embodiment, the added ribonucleotides are based on the sequence of the target gene. Even in this embodiment, full complementarity between the target sequence and the antisense siRNA is not required.

The first and second oligonucleotides of a DsiRNA agent of the instant invention are not required to be completely complementary. They only need to be sufficiently complementary to anneal under biological conditions and to provide a substrate for Dicer that produces a siRNA sufficiently complementary to the target sequence. Locked nucleic acids, or LNA's, are well known to a skilled artisan (Elmen et al., 2005, *Nucleic Acids Res* 33: 439-447; Kurreck et al., 2002, *Nucleic Acids Res* 30: 1911-1918; Crinelli et al., 2002, *Nucleic Acids Res* 30: 2435-2443; Braasch and Corey, 2001, *Chem Biol* 8: 1-7; Bondensgaard et al., 2000, *Chemistry* 6: 2687-2695; Wahlestedt et al., 2000, *Proc Nall Acad Sci USA* 97: 5633-5638). In one embodiment, an LNA is incorporated at the 5' terminus of the sense strand. In another embodiment, an LNA is incorporated at the 5' terminus of the sense strand in duplexes designed to include a 3' overhang on the antisense strand.

In certain embodiments, the DsiRNA agent of the instant invention has an asymmetric structure, with the sense strand having a 25-base pair length, and the antisense strand having a 27-base pair length with a 2 base 3'-overhang. In other embodiments, this DsiRNA agent having an asymmetric structure further contains 2 deoxynucleotides at the 3' end of the sense strand in place of two of the ribonucleotides.

Certain DsiRNA agent compositions containing two separate oligonucleotides can be linked by a third structure. The third structure will not block Dicer activity on the DsiRNA agent and will not interfere with the directed destruction of the RNA transcribed from the target gene. In one embodiment, the third structure may be a chemical linking group. Many suitable chemical linking groups are known in the art and can be used. Alternatively, the third structure may be an oligonucleotide that links the two oligonucleotides of the DsiRNA agent in a manner such that a hairpin structure is produced upon annealing of the two oligonucleotides making up the dsRNA composition. The hairpin structure will not block Dicer activity on the DsiRNA agent and will not interfere with the directed destruction of the CKAP5 RNA.

CKAP5 cDNA and Polypeptide Sequences

Known human and mouse CKAP5 cDNA and polypeptide sequences include the following: human CKAP5 transcript variants 1 (NM_001008938.3) and 2 (NM_014756.3); corresponding human CKAP5 polypeptide sequences GenBank Accession Nos. NP_001008938.1 (transcript variant 1) and NP_055571.2 (transcript variant 2); mouse wild-type CKAP5 sequence GenBank Accession No. NM_001165989.1 (*Mus musculus* C57BL/6 CKAP5 transcript) and corresponding mouse CKAP5 polypeptide sequence GenBank Accession No. NP_001159461.1.

In Vitro Assay to Assess dsRNA CKAP5 Inhibitory Activity

An in vitro assay that recapitulates RNAi in a cell-free system can be used to evaluate dsRNA constructs targeting CKAP5 RNA sequence(s), and thus to assess CKAP5-specific gene inhibitory activity (also referred to herein as CKAP5 inhibitory activity) of a dsRNA. The assay comprises the system described by Tuschl et al., 1999, Genes and Development, 13, 3191-3197 and Zamore et al., 2000, Cell, 101, 25-33 adapted for use with dsRNA (e.g., DsiRNA) agents directed against CKAP5 RNA. A *Drosophila* extract derived from syncytial blastoderm is used to reconstitute RNAi activity in vitro. Target RNA is generated via in vitro transcription from a selected CKAP5 expressing plasmid using T7 RNA polymerase or via chemical synthesis. Sense and antisense dsRNA strands (for example, 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing dsRNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and pre-incubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which dsRNA is omitted from the reaction.

Alternately, internally-labeled target RNA for the assay is prepared by in vitro transcription in the presence of [$\alpha$-$^{32}$P] CTP, passed over a G50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without dsRNA and the cleavage products generated by the assay.

In one embodiment, this assay is used to determine target sites in the CKAP5 RNA target for dsRNA mediated RNAi cleavage, wherein a plurality of dsRNA constructs are screened for RNAi mediated cleavage of the CKAP5 RNA target, for example, by analyzing the assay reaction by electrophoresis of labeled target RNA, or by northern blotting, as well as by other methodology well known in the art.

In certain embodiments, a dsRNA of the invention is deemed to possess CKAP5 inhibitory activity if, e.g., a 50% reduction in CKAP5 RNA levels is observed in a system, cell, tissue or organism, relative to a suitable control. Additional metes and bounds for determination of CKAP5 inhibitory activity of a dsRNA of the invention are described supra.

Conjugation and Delivery of Anti-CKAP5 dsRNA Agents

In certain embodiments the present invention relates to a method for treating a subject having a CKAP5-associated disease or disorder, or at risk of developing a CKAP5-associated disease or disorder. In such embodiments, the dsRNA can act as novel therapeutic agents for controlling the CKAP5-associated disease or disorder. The method comprises administering a pharmaceutical composition of the invention to the patient (e.g., human), such that the expression, level and/or activity of a CKAP5 RNA is reduced. The expression, level and/or activity of a polypeptide encoded by a CKAP5 RNA might also be reduced by a dsRNA of the instant invention, even where said dsRNA is directed against a non-coding region of the CKAP5 transcript (e.g., a targeted 5' UTR or 3' UTR sequence). Because of their high specificity, the dsRNAs of the present invention can specifically target CKAP5 sequences of cells and tissues, optionally in an allele-specific manner where polymorphic alleles exist within an individual and/or population.

In the treatment of a CKAP5-associated disease or disorder, the dsRNA can be brought into contact with the cells or tissue of a subject, e.g., the cells or tissue of a subject exhibiting disregulation of CKAP5 and/or otherwise targeted for reduction of CKAP5 levels. For example, dsRNA substantially identical to all or part of a CKAP5 RNA sequence may be brought into contact with or introduced into such a cell, either in vivo or in vitro. Similarly, dsRNA substantially identical to all or part of a CKAP5 RNA sequence may be administered directly to a subject having or at risk of developing a CKAP5-associated disease or disorder.

Therapeutic use of the dsRNA agents of the instant invention can involve use of formulations of dsRNA agents comprising multiple different dsRNA agent sequences. For example, two or more, three or more, four or more, five or more, etc. of the presently described agents can be combined to produce a formulation that, e.g., targets multiple different regions of the CKAP5 RNA, or that not only target CKAP5 RNA but also target, e.g., cellular target genes associated with a CKAP5-associated disease or disorder. A dsRNA agent of the instant invention may also be constructed such that either strand of the dsRNA agent independently targets two or more regions of CKAP5 RNA, or such that one of the strands of the dsRNA agent targets a cellular target gene of CKAP5 known in the art.

Use of multifunctional dsRNA molecules that target more then one region of a target nucleic acid molecule can also provide potent inhibition of CKAP5 RNA levels and expression. For example, a single multifunctional dsRNA construct of the invention can target both the CKAP5-604 and CKAP5-853 sites simultaneously; additionally and/or alternatively, single or multifunctional agents of the invention can be designed to selectively target one splice variant of CKAP5 over another.

Thus, the dsRNA agents of the instant invention, individually, or in combination or in conjunction with other drugs, can be used to treat, inhibit, reduce, or prevent a CKAP5-associated disease or disorder. For example, the dsRNA molecules can be administered to a subject or can be administered to other appropriate cells evident to those skilled in the art, individually or in combination with one or more drugs under conditions suitable for the treatment.

The dsRNA molecules also can be used in combination with other known treatments to treat, inhibit, reduce, or prevent a CKAP5-associated disease or disorder in a subject or organism. For example, the described molecules could be used in combination with one or more known compounds, treatments, or procedures to treat, inhibit, reduce, or prevent a CKAP5-associated disease or disorder in a subject or organism as are known in the art.

A dsRNA agent of the invention can be conjugated (e.g., at its 5' or 3' terminus of its sense or antisense strand) or unconjugated to another moiety (e.g. a non-nucleic acid moiety such as a peptide), an organic compound (e.g., a dye, cholesterol, or the like). Modifying dsRNA agents in this way may improve cellular uptake or enhance cellular targeting activities of the resulting dsRNA agent derivative as compared to the corresponding unconjugated dsRNA agent, are useful for tracing the dsRNA agent derivative in the cell, or improve the stability of the dsRNA agent derivative compared to the corresponding unconjugated dsRNA agent.

Methods of Introducing Nucleic Acids, Vectors, and Host Cells dsRNA agents of the invention may be directly introduced into a cell (i.e., intracellularly); or introduced extracellularly into a cavity, interstitial space, into the circulation of an organism, introduced orally, or may be introduced by bathing a cell or organism in a solution containing the nucleic acid. Vascular or extravascular circulation, the blood or lymph system, and the cerebrospinal fluid are sites where the nucleic acid may be introduced.

The dsRNA agents of the invention can be introduced using nucleic acid delivery methods known in art including injection of a solution containing the nucleic acid, bombardment by particles covered by the nucleic acid, soaking the cell or organism in a solution of the nucleic acid, or electroporation of cell membranes in the presence of the nucleic acid. Other methods known in the art for introducing nucleic acids to cells may be used, such as lipid-mediated carrier transport, chemical-mediated transport, and cationic liposome transfection such as calcium phosphate, and the like. The nucleic acid may be introduced along with other components that perform one or more of the following activities: enhance nucleic acid uptake by the cell or otherwise increase inhibition of the target CKAP5 RNA.

A cell having a target CKAP5 RNA may be from the germ line or somatic, totipotent or pluripotent, dividing or non-dividing, parenchyma or epithelium, immortalized or transformed, or the like. The cell may be a stem cell or a differentiated cell. Cell types that are differentiated include adipocytes, fibroblasts, myocytes, cardiomyocytes, endothelium, neurons, glia, blood cells, megakaryocytes, lymphocytes, macrophages, neutrophils, eosinophils, basophils, mast cells, leukocytes, granulocytes, keratinocytes, chondrocytes, osteoblasts, osteoclasts, hepatocytes, and cells of the endocrine or exocrine glands.

Depending on the particular target CKAP5 RNA sequence and the dose of dsRNA agent material delivered, this process may provide partial or complete loss of function for the CKAP5 RNA. A reduction or loss of RNA levels or expression (either CKAP5 RNA expression or encoded polypeptide expression) in at least 50%, 60%, 70%, 80%, 90%, 95% or 99% or more of targeted cells is exemplary. Inhibition of CKAP5 RNA levels or expression refers to the absence (or observable decrease) in the level of CKAP5 RNA or CKAP5 RNA-encoded protein. Specificity refers to the ability to inhibit the CKAP5 RNA without manifest effects on other genes of the cell. The consequences of inhibition can be confirmed by examination of the outward properties of the cell or organism or by biochemical techniques such as RNA solution hybridization, nuclease protection, Northern hybridization, reverse transcription, gene expression monitoring with a microarray, antibody binding, enzyme linked immunosorbent assay (ELISA), Western blotting, radioimmunoassay (RIA), other immunoassays, and fluorescence activated cell analysis (FACS). Inhibition of target CKAP5 RNA sequence(s) by the dsRNA agents of the invention also can be measured based upon the effect of administration of such dsRNA agents upon development/progression of a CKAP5-associated disease or disorder, e.g., tumor formation, growth, metastasis, etc., either in vivo or in vitro. Treatment and/or reductions in tumor or cancer cell levels can include halting or reduction of growth of tumor or cancer cell levels or reductions of, e.g., 10%, 20%, 30%, 40%, 50%, 60%, 70%, 80%, 90%, 95% or 99% or more, and can also be measured in logarithmic terms, e.g., 10-fold, 100-fold, 1000-fold, $10^5$-fold, $10^6$-fold, $10^7$-fold reduction in cancer cell levels could be achieved via administration of the dsRNA agents of the invention to cells, a tissue, or a subject.

For RNA-mediated inhibition in a cell line or whole organism, expression a reporter or drug resistance gene whose protein product is easily assayed can be measured. Such reporter genes include acetohydroxyacid synthase (AHAS), alkaline phosphatase (AP), beta galactosidase (LacZ), beta glucoronidase (GUS), chloramphenicol acetyl-transferase (CAT), green fluorescent protein (GFP), horseradish peroxidase (HRP), luciferase (Luc), nopaline synthase (NOS), octopine synthase (OCS), and derivatives thereof. Multiple selectable markers are available that confer resistance to ampicillin, bleomycin, chloramphenicol, gentamycin, hygromycin, kanamycin, lincomycin, methotrexate, phosphinothricin, puromycin, and tetracyclin. Depending on the assay, quantitation of the amount of gene expression allows one to determine a degree of inhibition which is greater than 10%, 33%, 50%, 90%, 95% or 99% as compared to a cell not treated according to the present invention.

Lower doses of injected material and longer times after administration of RNA silencing agent may result in inhibition in a smaller fraction of cells (e.g., at least 10%, 20%, 50%, 75%, 90%, or 95% of targeted cells). Quantitation of gene expression in a cell may show similar amounts of inhibition at the level of accumulation of target CKAP5 RNA or translation of target protein. As an example, the efficiency of inhibition may be determined by assessing the amount of gene product in the cell; RNA may be detected with a hybridization probe having a nucleotide sequence outside the region used for the inhibitory dsRNA, or translated polypeptide may be detected with an antibody raised against the polypeptide sequence of that region.

The dsRNA agent may be introduced in an amount which allows delivery of at least one copy per cell. Higher doses (e.g., at least 5, 10, 100, 500 or 1000 copies per cell) of material may yield more effective inhibition; lower doses may also be useful for specific applications.

CKAP5 Biology and CKAP5-Targeting Therapeutics

CKAP5 is a microtubule-associated protein that in humans is encoded by the CKAP5 gene (Nagase et al. *DNA Res.* 2: 37-43; Charrasse et al. *Eur J Biochem* 234: 406-13; "Entrez Gene: CKAP5 cytoskeleton associated protein 5"). CKAP5 is also known as ch-TOG, and the *Xenopus* CKAP5 homolog is XMAP215 (Cassimeris and Morabito. *Molecular Biology of the Cell* 15: 1580-1590).

The CKAP5 protein plays at least two distinct roles in spindle formation: it protects kinetochore microtubules from depolymerization by MCAK (KIF2C), while CKAP5 protein also plays an essential role in centrosomal microtubule assembly, a function independent of MCAK activity (Barr and Gergely. *Molecular and Cellular Biology* 28: 7199-7211). It has also been shown to interact with TACC1, which is a candidate breast cancer gene (Conte et al. *Oncogene* 22: 8102-16; Lauffart et al. *Biochem. J.* 363: 195-200; "Entrez Gene: TACC1 transforming, acidic coiled-coil containing protein 1").

The CKAP5-inhibiting double stranded nucleic acids of the instant invention can be used alone, or in combination with any art-recognized CKAP5-targeting therapeutic.

Pharmaceutical Compositions

In certain embodiments, the present invention provides for a pharmaceutical composition comprising the dsRNA agent of the present invention. The dsRNA agent sample can be suitably formulated and introduced into the environment of the cell by any means that allows for a sufficient portion of the sample to enter the cell to induce gene silencing, if it is to occur. Many formulations for dsRNA are known in the art and can be used so long as the dsRNA gains entry to the target cells so that it can act. See, e.g., U.S. published patent application Nos. 2004/0203145 A1 and 2005/0054598 A1. For example, the dsRNA agent of the instant invention can be formulated in buffer solutions such as phosphate buffered saline solutions, liposomes, micellar structures, and capsids. Formulations of dsRNA agent with cationic lipids can be used to facilitate transfection of the dsRNA agent into cells. For example, cationic lipids, such as lipofectin (U.S. Pat. No. 5,705,188), cationic glycerol derivatives, and polycationic molecules, such as polylysine (published PCT International Application WO 97/30731), can be used. Suitable lipids include Oligofectamine, Lipofectamine (Life Technologies), NC388 (Ribozyme Pharmaceuticals, Inc., Boulder, Colo.), or FuGene 6 (Roche) all of which can be used according to the manufacturer's instructions.

Such compositions typically include the nucleic acid molecule and a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Supplementary active compounds can also be incorporated into the compositions.

A pharmaceutical composition is formulated to be compatible with its intended route of administration. Examples of routes of administration include parenteral, e.g., intravenous, intradermal, subcutaneous, oral (e.g., inhalation), transdermal (topical), transmucosal, and rectal administration. Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersion. For intravenous administration, suitable carriers include physiological saline, bacteriostatic water, Cremophor EL™ (BASF, Parsippany, N.J.) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in a selected solvent with one or a combination of ingredients enumerated above, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying which yields a powder of the active ingredient plus any additional desired ingredient from a previously sterile-filtered solution thereof.

Oral compositions generally include an inert diluent or an edible carrier. For the purpose of oral therapeutic administration, the active compound can be incorporated with excipients and used in the form of tablets, troches, or capsules, e.g., gelatin capsules. Oral compositions can also be prepared using a fluid carrier for use as a mouthwash. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring.

For administration by inhalation, the compounds are delivered in the form of an aerosol spray from pressured container or dispenser which contains a suitable propellant, e.g., a gas such as carbon dioxide, or a nebulizer. Such methods include those described in U.S. Pat. No. 6,468,798.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art.

The compounds can also be prepared in the form of suppositories (e.g., with conventional suppository bases such as cocoa butter and other glycerides) or retention enemas for rectal delivery.

The compounds can also be administered by transfection or infection using methods known in the art, including but not limited to the methods described in McCaffrey et al. (2002), Nature, 418(6893), 38-9 (hydrodynamic transfection); Xia et al. (2002), Nature Biotechnol., 20(10), 1006-10 (viral-mediated delivery); or Putnam (1996), Am. J. Health Syst. Pharm. 53(2), 151-160, erratum at Am. J. Health Syst. Pharm. 53(3), 325 (1996).

The compounds can also be administered by a method suitable for administration of nucleic acid agents, such as a DNA vaccine. These methods include gene guns, bio injectors, and skin patches as well as needle-free methods such as the micro-particle DNA vaccine technology disclosed in U.S. Pat. No. 6,194,389, and the mammalian transdermal needle-free vaccination with powder-form vaccine as disclosed in U.S. Pat. No. 6,168,587. Additionally, intranasal delivery is possible, as described in, inter alia, Hamajima et al. (1998), Clin. Immunol. Immunopathol., 88(2), 205-10. Liposomes (e.g., as described in U.S. Pat. No. 6,472,375) and microencapsulation can also be used. Biodegradable targetable microparticle delivery systems can also be used (e.g., as described in U.S. Pat. No. 6,471,996).

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Such formulations can be prepared using standard techniques. The materials can also be obtained commercially from Alza Corporation and Nova Pharmaceuticals, Inc. Liposomal suspensions (including liposomes targeted to infected cells with monoclonal antibodies to viral antigens) can also be used as pharmaceutically acceptable carriers. These can be prepared according to methods known to those skilled in the art, for example, as described in U.S. Pat. No. 4,522,811.

Toxicity and therapeutic efficacy of such compounds can be determined by standard pharmaceutical procedures in cell cultures or experimental animals, e.g., for determining the $LD_{50}$ (the dose lethal to 50% of the population) and the $ED_{50}$ (the dose therapeutically effective in 50% of the population). The dose ratio between toxic and therapeutic effects is the therapeutic index and it can be expressed as the ratio $LD_{50}/ED_{50}$. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from the cell culture assays and animal studies can be used in formulating a range of dosage for use in humans. The dosage of such compounds lies preferably within a range of circulating concentrations that include the $ED_{50}$ with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range that includes the $IC_{50}$ (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

As defined herein, a therapeutically effective amount of a nucleic acid molecule (i.e., an effective dosage) depends on the nucleic acid selected. For instance, single dose amounts of a dsRNA (or, e.g., a construct(s) encoding for such dsRNA) in the range of approximately 1 pg to 1000 mg may be administered; in some embodiments, 10, 30, 100, or 1000 pg, or 10, 30, 100, or 1000 ng, or 10, 30, 100, or 1000 µg, or 10, 30, 100, or 1000 mg may be administered. In some embodiments, 1-5 g of the compositions can be administered. The compositions can be administered one from one or more times per day to one or more times per week; including once every other day. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of a nucleic acid (e.g., dsRNA), protein, polypeptide, or antibody can include a single treatment or, preferably, can include a series of treatments.

The nucleic acid molecules of the invention can be inserted into expression constructs, e.g., viral vectors, retroviral vectors, expression cassettes, or plasmid viral vectors, e.g., using methods known in the art, including but not limited to those described in Xia et al., (2002), supra. Expression constructs can be delivered to a subject by, for example, inhalation, orally, intravenous injection, local administration (see U.S. Pat. No. 5,328,470) or by stereotactic injection (see e.g., Chen et al. (1994), Proc. Natl. Acad. Sci. USA, 91, 3054-3057). The pharmaceutical preparation of the delivery vector can include the vector in an acceptable diluent, or can comprise a slow release matrix in which the delivery vehicle is imbedded. Alternatively, where the complete delivery vector can be produced intact from recombinant cells, e.g., retroviral vectors, the pharmaceutical preparation can include one or more cells which produce the gene delivery system.

The expression constructs may be constructs suitable for use in the appropriate expression system and include, but are not limited to retroviral vectors, linear expression cassettes, plasmids and viral or virally-derived vectors, as known in the art. Such expression constructs may include one or more inducible promoters, RNA Pol III promoter systems such as U6 snRNA promoters or H1 RNA polymerase III promoters, or other promoters known in the art. The constructs can include one or both strands of the siRNA. Expression constructs expressing both strands can also include loop structures linking both strands, or each strand can be separately transcribed from separate promoters within the same construct. Each strand can also be transcribed from a separate expression construct, e.g., Tuschl (2002, *Nature Biotechnol* 20: 500-505).

It can be appreciated that the method of introducing dsRNA agents into the environment of the cell will depend on the type of cell and the make up of its environment. For example, when the cells are found within a liquid, one preferable formulation is with a lipid formulation such as in lipofectamine and the dsRNA agents can be added directly to the liquid environment of the cells. Lipid formulations can also be administered to animals such as by intravenous, intramuscular, or intraperitoneal injection, or orally or by inhalation or other methods as are known in the art. When the formulation is suitable for administration into animals such as mammals and more specifically humans, the formulation is also pharmaceutically acceptable. Pharmaceutically acceptable formulations for administering oligonucleotides are known and can be used. In some instances, it may be preferable to formulate dsRNA agents in a buffer or saline solution and directly inject the formulated dsRNA agents into cells, as in studies with oocytes. The direct injection of dsRNA agent duplexes may also be done. For suitable methods of introducing dsRNA (e.g., DsiRNA agents), see U.S. published patent application No. 2004/0203145 A1.

Suitable amounts of a dsRNA agent must be introduced and these amounts can be empirically determined using standard methods. Typically, effective concentrations of individual dsRNA agent species in the environment of a cell will be 50 nanomolar or less, 10 nanomolar or less, or compositions in which concentrations of 1 nanomolar or less can be used. In another embodiment, methods utilizing a concentration of 200 picomolar or less, 100 picomolar or less, 50 picomolar or less, 20 picomolar or less, and even a concentration of 10 picomolar or less, 5 picomolar or less, 2 picomolar or less or 1 picomolar or less can be used in many circumstances.

The method can be carried out by addition of the dsRNA agent compositions to an extracellular matrix in which cells can live provided that the dsRNA agent composition is formulated so that a sufficient amount of the dsRNA agent can enter the cell to exert its effect. For example, the method is amenable for use with cells present in a liquid such as a liquid culture or cell growth media, in tissue explants, or in whole organisms, including animals, such as mammals and especially humans.

The level or activity of a CKAP5 RNA can be determined by a suitable method now known in the art or that is later developed. It can be appreciated that the method used to measure a target RNA and/or the expression of a target RNA can depend upon the nature of the target RNA. For example, where the target CKAP5 RNA sequence encodes a protein, the term "expression" can refer to a protein or the CKAP5 RNA/transcript derived from the CKAP5 gene (either genomic or of exogenous origin). In such instances the expression of the target CKAP5 RNA can be determined by measuring the amount of CKAP5 RNA/transcript directly or by measuring the amount of CKAP5 protein. Protein can be measured in protein assays such as by staining or immunoblotting or, if the protein catalyzes a reaction that can be measured, by measuring reaction rates. All such methods are known in the art and can be used. Where target CKAP5 RNA levels are to be measured, art-recognized methods for detecting RNA levels can be used (e.g., RT-PCR, Northern Blotting, etc.). In targeting CKAP5 RNAs with the dsRNA agents of the instant invention, it is also anticipated that measurement of the efficacy of a dsRNA agent in reducing levels of CKAP5 RNA or protein in a subject, tissue, in cells, either in vitro or in vivo, or in cell extracts can also be used to determine the extent of reduction of CKAP5-associated phenotypes (e.g., disease or disorders, e.g., cancer or tumor formation, growth, metastasis, spread, etc.). The above measurements can be made on cells, cell extracts, tissues, tissue extracts or other suitable source material.

The determination of whether the expression of a CKAP5 RNA has been reduced can be by a suitable method that can reliably detect changes in RNA levels. Typically, the determination is made by introducing into the environment of a cell undigested dsRNA such that at least a portion of that dsRNA agent enters the cytoplasm, and then measuring the level of the target RNA. The same measurement is made on identical untreated cells and the results obtained from each measurement are compared.

The dsRNA agent can be formulated as a pharmaceutical composition which comprises a pharmacologically effective amount of a dsRNA agent and pharmaceutically acceptable carrier. A pharmacologically or therapeutically effective amount refers to that amount of a dsRNA agent effective to produce the intended pharmacological, therapeutic or preventive result. The phrases "pharmacologically effective amount" and "therapeutically effective amount" or simply "effective amount" refer to that amount of an RNA effective to produce the intended pharmacological, therapeutic or preventive result. For example, if a given clinical treatment is considered effective when there is at least a 20% reduction in a measurable parameter associated with a disease or disorder, a therapeutically effective amount of a drug for the treatment of that disease or disorder is the amount necessary to effect at least a 20% reduction in that parameter.

Suitably formulated pharmaceutical compositions of this invention can be administered by means known in the art such as by parenteral routes, including intravenous, intramuscular, intraperitoneal, subcutaneous, transdermal, airway (aerosol), rectal, vaginal and topical (including buccal and sublingual) administration. In some embodiments, the pharmaceutical compositions are administered by intravenous or intraparenteral infusion or injection.

In general, a suitable dosage unit of dsRNA will be in the range of 0.001 to 0.25 milligrams per kilogram body weight of the recipient per day, or in the range of 0.01 to 20 micrograms per kilogram body weight per day, or in the range of 0.001 to 5 micrograms per kilogram of body weight per day, or in the range of 1 to 500 nanograms per kilogram of body weight per day, or in the range of 0.01 to 10 micrograms per kilogram body weight per day, or in the range of 0.10 to 5 micrograms per kilogram body weight per day, or in the range of 0.1 to 2.5 micrograms per kilogram body weight per day. A pharmaceutical composition comprising the dsRNA can be administered once daily. However, the therapeutic agent may also be dosed in dosage units containing two, three, four, five, six or more sub-doses administered at appropriate intervals throughout the day. In that case, the dsRNA contained in each sub-dose must be correspondingly smaller in order to achieve the total daily dosage unit. The dosage unit can also be compounded for a single dose over several days, e.g., using a conventional sustained release formulation which provides sustained and consistent release of the dsRNA over a several day period. Sustained release formulations are well known in the art. In this embodiment, the dosage unit contains a corresponding multiple of the daily dose. Regardless of the formulation, the pharmaceutical composition must contain dsRNA in a quantity sufficient to inhibit expression of the target gene in the animal or human being treated. The composition can be compounded in such a way that the sum of the multiple units of dsRNA together contain a sufficient dose.

Data can be obtained from cell culture assays and animal studies to formulate a suitable dosage range for humans. The dosage of compositions of the invention lies within a range of circulating concentrations that include the $ED_{50}$ (as determined by known methods) with little or no toxicity. The dosage may vary within this range depending upon the dosage form employed and the route of administration utilized. For a compound used in the method of the invention, the therapeutically effective dose can be estimated initially from cell culture assays. A dose may be formulated in animal models to achieve a circulating plasma concentration range of the compound that includes the $IC_{50}$ (i.e., the concentration of the test compound which achieves a half-maximal inhibition of symptoms) as determined in cell culture. Such information can be used to more accurately determine useful doses in humans. Levels of dsRNA in plasma may be measured by standard methods, for example, by high performance liquid chromatography.

The pharmaceutical compositions can be included in a kit, container, pack, or dispenser together with instructions for administration.

Methods of Treatment

The present invention provides for both prophylactic and therapeutic methods of treating a subject at risk of (or susceptible to) a disease or disorder caused, in whole or in part, by CKAP5 (e.g., misregulation and/or elevation of CKAP5 transcript and/or CKAP5 protein levels), or treatable via selective targeting of CKAP5.

"Treatment", or "treating" as used herein, is defined as the application or administration of a therapeutic agent (e.g., a dsRNA agent or vector or transgene encoding same) to a patient, or application or administration of a therapeutic agent to an isolated tissue or cell line from a patient, who has the disease or disorder, a symptom of disease or disorder or a predisposition toward a disease or disorder, with the purpose to cure, heal, alleviate, relieve, alter, remedy, ameliorate, improve or affect the disease or disorder, the symptoms of the disease or disorder, or the predisposition toward disease.

In one aspect, the invention provides a method for preventing in a subject, a disease or disorder as described above (including, e.g., prevention of the commencement of transforming events within a subject via inhibition of CKAP5 expression), by administering to the subject a therapeutic agent (e.g., a dsRNA agent or vector or transgene encoding same). Subjects at risk for the disease can be identified by, for example, one or a combination of diagnostic or prognostic assays as described herein. Administration of a prophylactic agent can occur prior to the detection of, e.g., cancer in a subject, or the manifestation of symptoms characteristic of the disease or disorder, such that the disease or disorder is prevented or, alternatively, delayed in its progression.

Another aspect of the invention pertains to methods of treating subjects therapeutically, i.e., altering the onset of symptoms of the disease or disorder. These methods can be performed in vitro (e.g., by culturing the cell with the dsRNA agent) or, alternatively, in vivo (e.g., by administering the dsRNA agent to a subject).

With regards to both prophylactic and therapeutic methods of treatment, such treatments may be specifically tailored or modified, based on knowledge obtained from the field of pharmacogenomics. "Pharmacogenomics", as used herein, refers to the application of genomics technologies such as gene sequencing, statistical genetics, and gene expression analysis to drugs in clinical development and on the market. More specifically, the term refers the study of how a patient's genes determine his or her response to a drug (e.g., a patient's "drug response phenotype", or "drug response genotype"). Thus, another aspect of the invention provides methods for tailoring an individual's prophylactic or therapeutic treatment with either the target CKAP5 RNA molecules of the present invention or target CKAP5 RNA modulators according to that individual's drug response genotype. Pharmacogenomics allows a clinician or physician to target prophylactic or therapeutic treatments to patients who will most benefit from the treatment and to avoid treatment of patients who will experience toxic drug-related side effects.

Therapeutic agents can be tested in a selected animal model. For example, a dsRNA agent (or expression vector or transgene encoding same) as described herein can be used in an animal model to determine the efficacy, toxicity, or side effects of treatment with said agent. Alternatively, an agent (e.g., a therapeutic agent) can be used in an animal model to determine the mechanism of action of such an agent.

Models Useful to Evaluate the Down-Regulation of CKAP5 mRNA Levels and Expression Cell Culture The dsRNA agents of the invention can be tested for cleavage activity in vivo, for example, using the following procedure. The nucleotide sequences within the CKAP5 cDNA targeted by the dsRNA agents of the invention are shown in the above CKAP5 sequences.

The dsRNA reagents of the invention can be tested in cell culture using HeLa or other mammalian cells to determine the extent of CKAP5 RNA and CKAP5 protein inhibition. In certain embodiments, DsiRNA reagents (e.g., see FIG. 1, and above-recited structures) are selected against the CKAP5 target as described herein. CKAP5 RNA inhibition is measured after delivery of these reagents by a suitable transfection agent to, for example, cultured HeLa cells or other transformed or non-transformed mammalian cells in culture. Relative amounts of target CKAP5 RNA are measured versus actin or other appropriate control using real-time PCR monitoring of amplification (e.g., ABI 7700 TAQMAN®). A comparison is made to the activity of oligonucleotide sequences made to unrelated targets or to a randomized DsiRNA control with the same overall length and chemistry, or simply to appropriate vehicle-treated or untreated controls. Primary and secondary lead reagents are chosen for the target and optimization performed.

TAQMAN® (Real-Time PCR Monitoring of Amplification) and Lightcycler Quantification of mRNA Total RNA is prepared from cells following DsiRNA delivery, for example, using Ambion Rnaqueous 4-PCR purification kit for large scale extractions, or Promega SV96 for 96-well assays. For Taqman analysis, dual-labeled probes are synthesized with, for example, the reporter dyes FAM or VIC covalently linked at the 5'-end and the quencher dye TAMCKAP5A conjugated to the 3'-end. PCR amplifications are performed on, for example, an ABI PRISM 7700 Sequence detector using 50 uL reactions consisting of 10 uL total RNA, 100 nM forward primer, 100 mM reverse primer, 100 nM probe, 1× TaqMan PCR reaction buffer (PE-Applied Biosystems), 5.5 mM MgCl2, 100 uM each dATP, dCTP, dGTP and dTTP, 0.2 U RNase Inhibitor (Promega), 0.025 U AmpliTaq Gold (PE-Applied Biosystems) and 0.2 U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of target CKAP5 mRNA level is determined relative to standards generated from serially diluted total cellular RNA (300, 100, 30, 10 ng/rxn) and normalizing to, for example, HPRT1 mRNA in either parallel or same tube TaqMan reactions.

Western Blotting

Cellular protein extracts can be prepared using a standard micro preparation technique (for example using RIPA buffer), or preferably, by extracting nuclear proteins by a method such as the NE-PER Nuclear and Cytoplasmic Extraction kit (Thermo-Fisher Scientific). Cellular protein extracts are run on Tris-Glycine polyacrylamide gel and transferred onto membranes. Non-specific binding can be blocked by incubation, for example, with 5% non-fat milk for 1 hour followed by primary antibody for 16 hours at 4° C. Following washes, the secondary antibody is applied, for example (1:10,000 dilution) for 1 hour at room temperature and the signal detected on a VersaDoc imaging system In several cell culture systems, cationic lipids have been shown to enhance the bioavailability of oligonucleotides to cells in culture (Bennet, et al., 1992, Mol. Pharmacology, 41, 1023-1033). In one embodiment, dsRNA molecules of the invention are complexed with cationic lipids for cell culture experiments. dsRNA and cationic lipid mixtures are prepared in serum-free OptimMEM (InVitrogen) immediately prior to addition to the cells. OptiMEM is warmed to room temperature (about 20-25° C.) and cationic lipid is added to the final desired concentration. dsRNA molecules are added to OptiMEM to the desired concentration and the solution is added to the diluted dsRNA and incubated for 15 minutes at room temperature. In dose response experiments, the RNA complex is serially diluted into OptiMEM prior to addition of the cationic lipid.

Animal Models

The efficacy of anti-CKAP5 dsRNA agents may be evaluated in an animal model. Animal models of cancer and/or proliferative diseases, conditions, or disorders as are known in the art can be used for evaluation of the efficacy, potency, toxicity, etc. of anti-CKAP5 dsRNAs. Suitable animal models of proliferative disease include, e.g., transgenic rodents (e.g., mice, rats) bearing gain of function proto-oncogenes (e.g., Myc, Src) and/or loss of function of tumour suppressor proteins (e.g., p53, Rb) or rodents that have been exposed to radiation or chemical mutagens that induce DNA changes that facilitate neoplastic transformation. Many such animal models are commercially available, for example, from The Jackson Laboratory, Bar Harbor, Me., USA. These animal models may be used as a source cells or tissue for assays of the compositions of the invention. Such models can also be used or adapted for use for pre-clinical evaluation of the efficacy of dsRNA compositions of the invention in modulating CKAP5 gene expression toward therapeutic use.

As in cell culture models, the most CKAP5 relevant mouse tumor xenografts are those derived from cancer cells that express CKAP5 proteins. Xenograft mouse models of cancer relevant to study of the anti-tumor effect of modulating mitotic-function genes like CKAP5 have been described by various groups (e.g., Judge et al., JCI 2009 March; 119(3): 661; Seth et al., 2011 May; 19(5): 928). Use of these models has demonstrated that inhibition of expression of mitotic-function genes, such as by siRNA-mediated gene silencing, causes inhibition of tumor growth in animals.

Such models can be used in evaluating the efficacy of dsRNA molecules of the invention to inhibit CKAP5 levels, expression, tumor/cancer formation, growth, spread, development of other CKAP5-associated phenotypes, diseases or disorders, etc. These models and others can similarly be used to evaluate the safety/toxicity and efficacy of dsRNA molecules of the invention in a pre-clinical setting.

Specific examples of animal model systems useful for evaluation of the CKAP5-targeting dsRNAs of the invention include wild-type mice, and orthotopic or subcutaneous MHCC97, A549, H1299, HepG2, Hep3B, SNU398, HuH7, NCI-H196, NCI-H1975, HT29, MKN-45, MDA-MB-231, NCI-H441, Panc-1, MiaPaCa, BxPC3, DU-145, M2182, VCaP, OvCar-3, ES-2, SKOV3, PC3, HCT116, A431, MCF-7, U937, KU-7, K562, HeLa, or T98Gtumor model mice. In an exemplary in vivo experiment, dsRNAs of the invention are tail vein injected into such mouse models at doses ranging from 1 to 10 mg/kg or, alternatively, repeated doses are administered at single-dose $IC_{50}$ levels, and organs (e.g., prostate, liver, kidney, lung, pancreas, colon, skin, spleen, bone marrow, lymph nodes, mammary fat pad, etc.) are harvested 24 hours after administration of the final dose. Such organs are then evaluated for mouse and/or human CKAP5 levels, depending upon the model used. Duration of action can also be examined at, e.g., 1, 4, 7, 14, 21 or more days after final dsRNA administration.

The practice of the present invention employs, unless otherwise indicated, conventional techniques of chemistry, molecular biology, microbiology, recombinant DNA, genetics, immunology, cell biology, cell culture and transgenic biology, which are within the skill of the art. See, e.g., Maniatis et al., 1982, Molecular Cloning (Cold Spring Harbor Laboratory Press, Cold Spring Harbor, N.Y.); Sambrook et al., 1989, Molecular Cloning, 2nd Ed. (Cold Spring Harbor Laboratory Press, Cold Spring Harbor, N.Y.); Sambrook and Russell, 2001, Molecular Cloning, 3rd Ed. (Cold Spring Harbor Laboratory Press, Cold Spring Harbor, N.Y.); Ausubel et al., 1992), Current Protocols in Molecular Biology (John Wiley & Sons, including periodic updates); Glover, 1985, DNA Cloning (IRL Press, Oxford); Anand, 1992; Guthrie and Fink, 1991; Harlow and Lane, 1988, Antibodies, (Cold Spring Harbor Laboratory Press, Cold Spring Harbor, N.Y.); Jakoby and Pastan, 1979; Nucleic Acid Hybridization (B. D. Hames & S. J. Higgins eds. 1984); Transcription And Translation (B. D. Hames & S. J. Higgins eds. 1984); Culture Of Animal Cells (R. I. Freshney, Alan R. Liss, Inc., 1987); Immobilized Cells And Enzymes (IRL Press, 1986); B. Perbal, A Practical Guide To Molecular Cloning (1984); the treatise, Methods In Enzymology (Academic Press, Inc., N.Y.); Gene Transfer Vectors For Mammalian Cells (J. H. Miller and M. P. Calos eds., 1987, Cold Spring Harbor Laboratory); Methods In Enzymology, Vols. 154 and 155 (Wu et al. eds.), Immunochemical Methods In Cell And Molecular Biology (Mayer and Walker, eds., Academic Press, London, 1987); Handbook Of Experimental Immunology, Volumes I-IV (D. M. Weir and C. C. Blackwell, eds., 1986); Riott, Essential Immunology, 6th Edition, Blackwell Scientific Publications, Oxford, 1988; Hogan et al., Manipulating the Mouse Embryo, (Cold Spring Harbor Laboratory Press, Cold Spring Harbor, N.Y., 1986); Westerfield, M., The zebrafish book. A guide for the laboratory use of zebrafish (*Danio rerio*), (4th Ed., Univ. of Oregon Press, Eugene, 2000).

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

EXAMPLES

The present invention is described by reference to the following Examples, which are offered by way of illustration and are not intended to limit the invention in any manner. Standard techniques well known in the art or the techniques specifically described below were utilized.

Example 1: Preparation of Double-Stranded RNA Oligonucleotides

Oligonucleotide Synthesis and Purification

DsiRNA molecules can be designed to interact with various sites in the RNA message, for example, target sequences within the RNA sequences described herein. In presently exemplified agents, in a first screen, 576 human target CKAP5 sequences were selected for evaluation (456 of the 576 human target CKAP5 sites were predicted to be conserved with corresponding sites in the mouse CKAP5 transcript sequence). The sequences of one strand of the DsiRNA molecules were complementary to the target CKAP5 site sequences described above. The DsiRNA molecules were chemically synthesized using methods described herein. Generally, DsiRNA constructs were synthesized using solid phase oligonucleotide synthesis methods as described for 19-23mer siRNAs (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086).

Individual RNA strands were synthesized and HPLC purified according to standard methods (Integrated DNA Technologies, Coralville, Iowa). For example, RNA oligonucleotides were synthesized using solid phase phosphoramidite chemistry, deprotected and desalted on NAP-5 columns (Amersham Pharmacia Biotech, Piscataway, N.J.) using standard techniques (Damha and Olgivie, 1993, *Methods Mol Biol* 20: 81-114; Wincott et al., 1995, *Nucleic Acids Res* 23: 2677-84). The oligomers were purified using ion-exchange high performance liquid chromatography (IE-HPLC) on an Amersham Source 15Q column (1.0 cm×25 cm; Amersham Pharmacia Biotech, Piscataway, N.J.) using a 15 min step-linear gradient. The gradient varies from 90:10 Buffers A:B to 52:48 Buffers A:B, where Buffer A is 100 mM Tris pH 8.5 and Buffer B is 100 mM Tris pH 8.5, 1 M NaCl. Samples were monitored at 260 nm and peaks corresponding to the full-length oligonucleotide species are collected, pooled, desalted on NAP-5 columns, and lyophilized.

The purity of each oligomer was determined by capillary electrophoresis (CE) on a Beckman PACE 5000 (Beckman Coulter, Inc., Fullerton, Calif.). The CE capillaries had a 100 µm inner diameter and contains ssDNA 100R Gel (Beckman-Coulter). Typically, about 0.6 nmole of oligonucleotide was injected into a capillary, run in an electric field of 444 V/cm and detected by UV absorbance at 260 nm. Denaturing Tris-Borate-7 M-urea running buffer was purchased from Beckman-Coulter. Oligoribonucleotides were obtained that are at least 90% pure as assessed by CE for use in experiments described below. Compound identity was verified by matrix-assisted laser desorption ionization time-of-flight (MALDI-TOF) mass spectroscopy on a Voyager DE™ Biospectometry Work Station (Applied Biosystems, Foster City, Calif.) following the manufacturer's recommended protocol. Relative molecular masses of all oligomers were obtained, often within 0.2% of expected molecular mass.

Preparation of Duplexes

Single-stranded RNA (ssRNA) oligomers were resuspended, e.g., at 100 µM concentration in duplex buffer consisting of 100 mM potassium acetate, 30 mM HEPES, pH 7.5. Complementary sense and antisense strands were mixed in equal molar amounts to yield a final solution of, e.g., 50 µM duplex. Samples were heated to 100° C. for 5' in RNA buffer (IDT) and allowed to cool to room temperature before use. Double-stranded RNA (dsRNA) oligomers were stored at −20° C. Single-stranded RNA oligomers were stored lyophilized or in nuclease-free water at −80° C.

Nomenclature

For consistency, the following nomenclature has been employed in the instant specification. Names given to duplexes indicate the length of the oligomers and the presence or absence of overhangs. A "25/27" is an asymmetric duplex having a 25 base sense strand and a 27 base antisense strand with a 2-base 3'-overhang. A "27/25" is an asymmetric duplex having a 27 base sense strand and a 25 base antisense strand.

Cell Culture and RNA Transfection

HeLa cells were obtained from ATCC and maintained in DMEM (HyClone) supplemented with 10% fetal bovine serum (HyClone) at 37° C. under 5% $CO_2$. Hepa 1-6 cells were obtained from ATCC and maintained in DMEM (HyClone) supplemented with 10% fetal bovine serum (HyClone) at 37° C. under 5% $CO_2$. For RNA transfections, cells were transfected with DsiRNAs as indicated at a final concentration of 1 nM, 0.3 nM or 0.1 nM using Lipofectamine™ RNAiMAX (Invitrogen) and following manufacturer's instructions. Briefly, for 0.1 nM transfections, e.g., of certain Examples below, an aliquot of stock solution of each DsiRNA was mixed with Opti-MEM I (Invitrogen) and Lipofectamine™ RNAiMAX to reach a volume of 150 µL (with 0.3 nM DsiRNA). The resulting 150 µL mix was incubated for 20 min at RT to allow DsiRNA:Lipofectamine™ RNAiMAX complexes to form. Meanwhile, target cells were trypsinized and resuspended in medium. At the end of the 20 min of complexation, 50 uL of the DsiRNA:RNAiMAX mixture was added per well into triplicate wells of 96 well plates. Finally, 100 µL of the cell suspension were added to each well (final volume 150 µL) and plates were placed into the incubator for 24 hours.

Assessment of CKAP5 Inhibition

CKAP5 target gene knockdown was determined by qRT-PCR, with values normalized to HPRT and SFRS9 housekeeping genes in human HeLa cells or to HPRT and RPL23 housekeeping genes in mouse Hepa 1-6 cells, and to transfections with control DsiRNAs and/or mock transfection controls.

RNA Isolation and Analysis

Media was aspirated, and total RNA was extracted using the SV96 kit (Promega). Total RNA was reverse-transcribed using SuperscriptII, Oligo dT, and random hexamers following manufacturer's instructions. Typically, the resulting cDNA was analyzed by qPCR using primers and probes specific for both the CKAP5 gene and for the human genes HPRT-1 and SFRS9 (or RPL23 in mouse Hepa 1-6 cells). An ABI 7700 was used for the amplification reactions. Each sample was tested in triplicate. Relative CKAP5 RNA levels were normalized to HPRT1 and SFRS9 (or RPL23) RNA levels and compared with RNA levels obtained in transfection control samples.

Example 2: DsiRNA Inhibition of CKAP5—Primary Screen

DsiRNA molecules targeting CKAP5 were designed and synthesized as described above and tested in human HeLa cells for inhibitory efficacy. For transfection, annealed DsiRNAs were mixed with the transfection reagent (Lipofectamine™ RNAiMAX, Invitrogen) and incubated for 20 minutes at room temperature. The HeLa (human) cells were trypsinized, resuspended in media, and added to wells (100 uL per well) to give a final DsiRNA concentration of 1 nM in a volume of 150 µl. Each DsiRNA transfection mixture was added to 3 wells for triplicate DsiRNA treatments. Cells were incubated at 37° C. for 24 hours in the continued presence of the DsiRNA transfection mixture. At 24 hours, RNA was prepared from each well of treated cells. The supernatants with the transfection mixtures were first removed and discarded, then the cells were lysed and RNA prepared from each well. Target CKAP5 RNA levels following treatment were evaluated by qRT-PCR for the CKAP5 target gene, with values normalized to those obtained for controls. Triplicate data was averaged and the % error determined for each treatment. Normalized data were graphed and the reduction of target mRNA by active DsiRNAs in comparison to controls was determined.

CKAP5 targeting DsiRNAs were examined for CKAP5 inhibitory efficacy in an initial primary phase of testing. In this example, 576 asymmetric DsiRNAs (tested DsiRNAs possessed a 25/27mer structure) were constructed and tested for CKAP5 inhibitory efficacy in human HeLa cells incubated in the presence of such DsiRNAs at a concentration of 1 nM. The 576 asymmetric DsiRNAs tested in the initial primary screen included DsiRNAs selected from Table 2 above, where underlined nucleotide residues indicate 2'-O-methyl modified residues, ribonucleotide residues are shown as UPPER CASE, and deoxyribonucleotide residues are shown as lower case. Such duplexes possessed an "M0-M48" modification pattern, referring to a duplex having a passenger strand carrying no 2'-O-methyl modified nucleotides ("M0") and a guide strand possessing the "M48" modification pattern of 2'-O-methyl modified nucleotides.

Assay of the 576 CKAP5 targeting DsiRNAs (456 targeting both human and mouse CKAP5 sequences, while 120 DsiRNAs were predicted to be human-specific) in human HeLa cells at 1 nM revealed their CKAP5 inhibitory efficacies. CKAP5 levels were determined using qPCR assays positioned at two locations within the CKAP5 transcript (for human HeLa cell experiments, paired qPCR assays were performed and are elsewhere indicated as "Hs CKAP5 798-913" (HEX) and "Hs CKAP5 5921-6017" (FAM).

255 of 576 assayed asymmetric DsiRNAs examined in human HeLa cells showed greater than 70% reduction of human CKAP5 levels in such cells at 1 nM. Of these 255 DsiRNAs, 61 exhibited 80% or greater reduction of human CKAP5 levels in HeLa cells at 1 nM in this initial screen for active CKAP5-targeting DsiRNAs.

Figures 2, 3, 4, 4A:
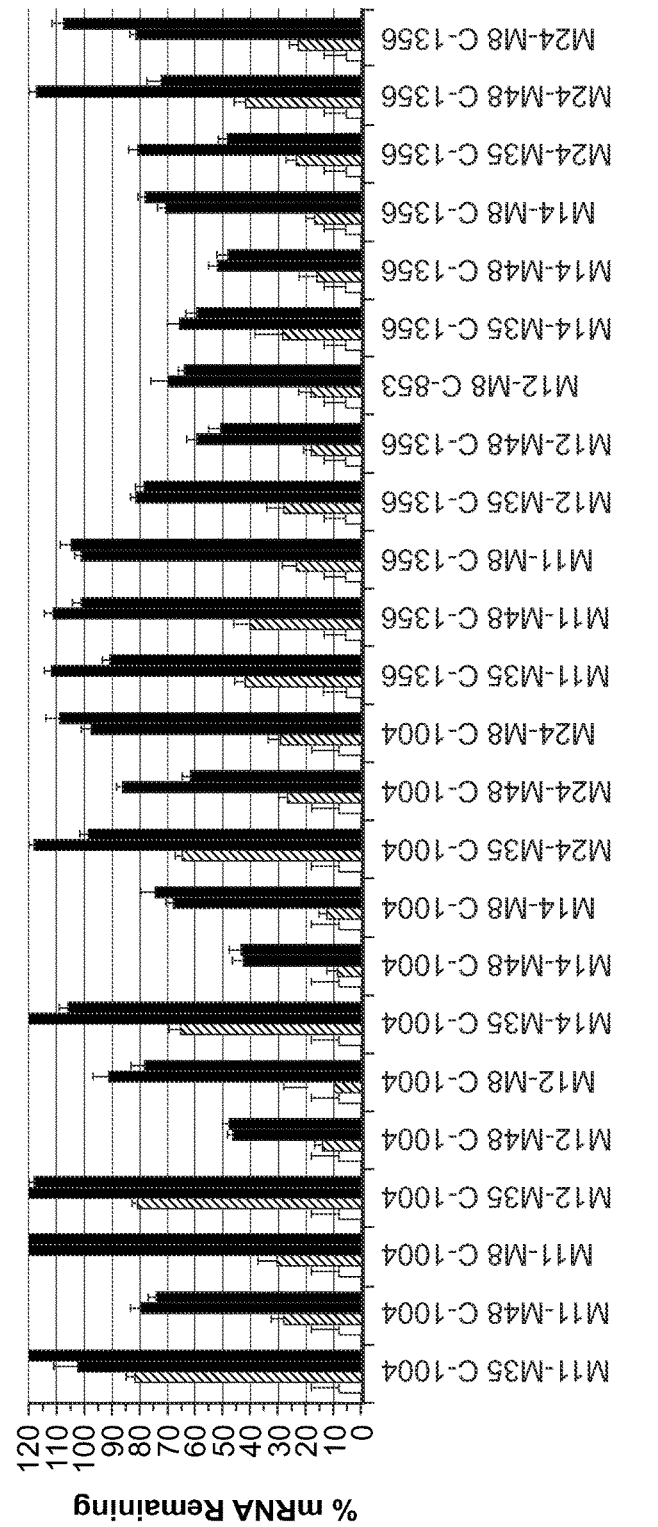
Figures 2, 3, 4, 4B:
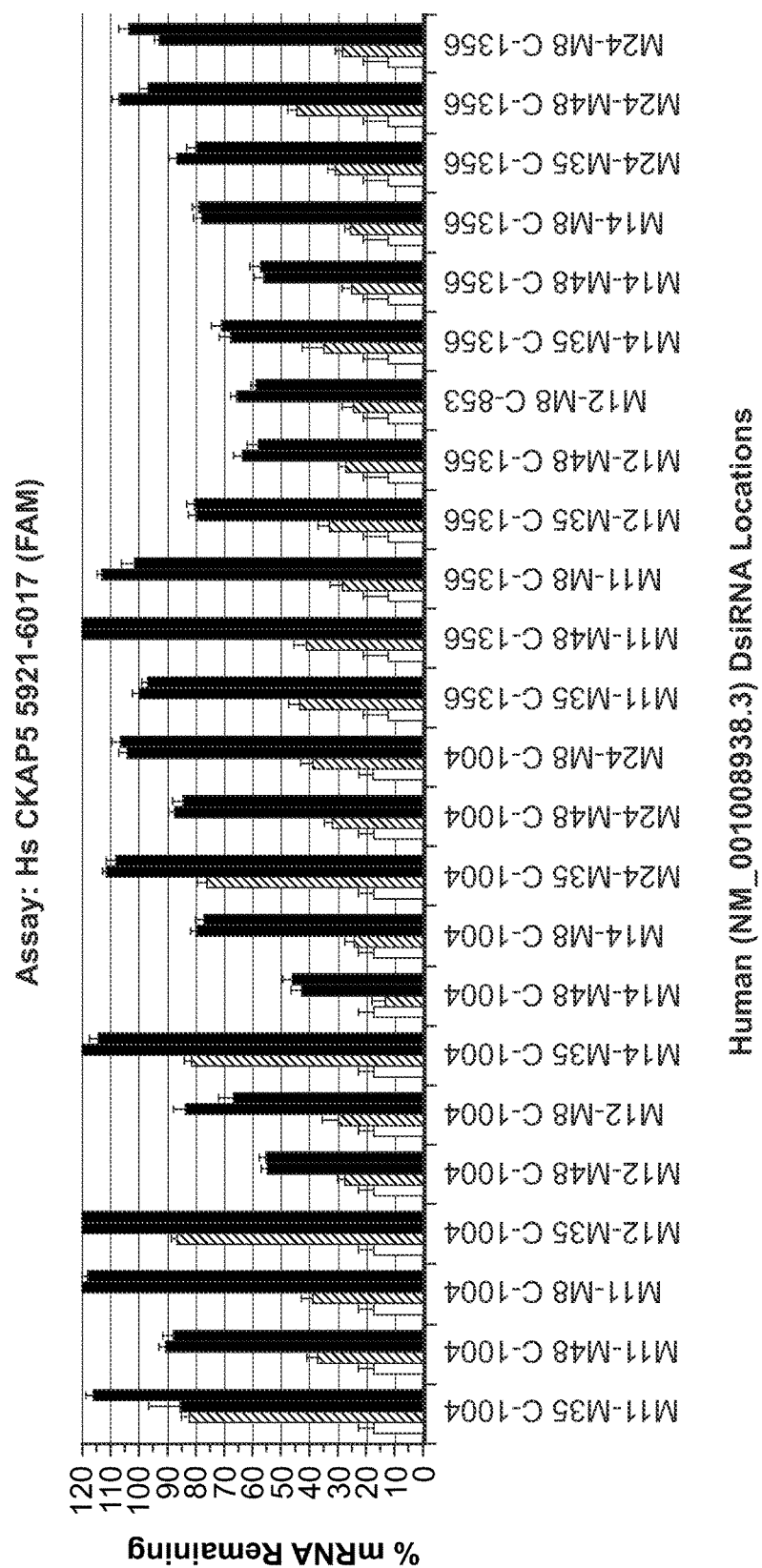
Figures 2, 3, 4, 5, 5A:
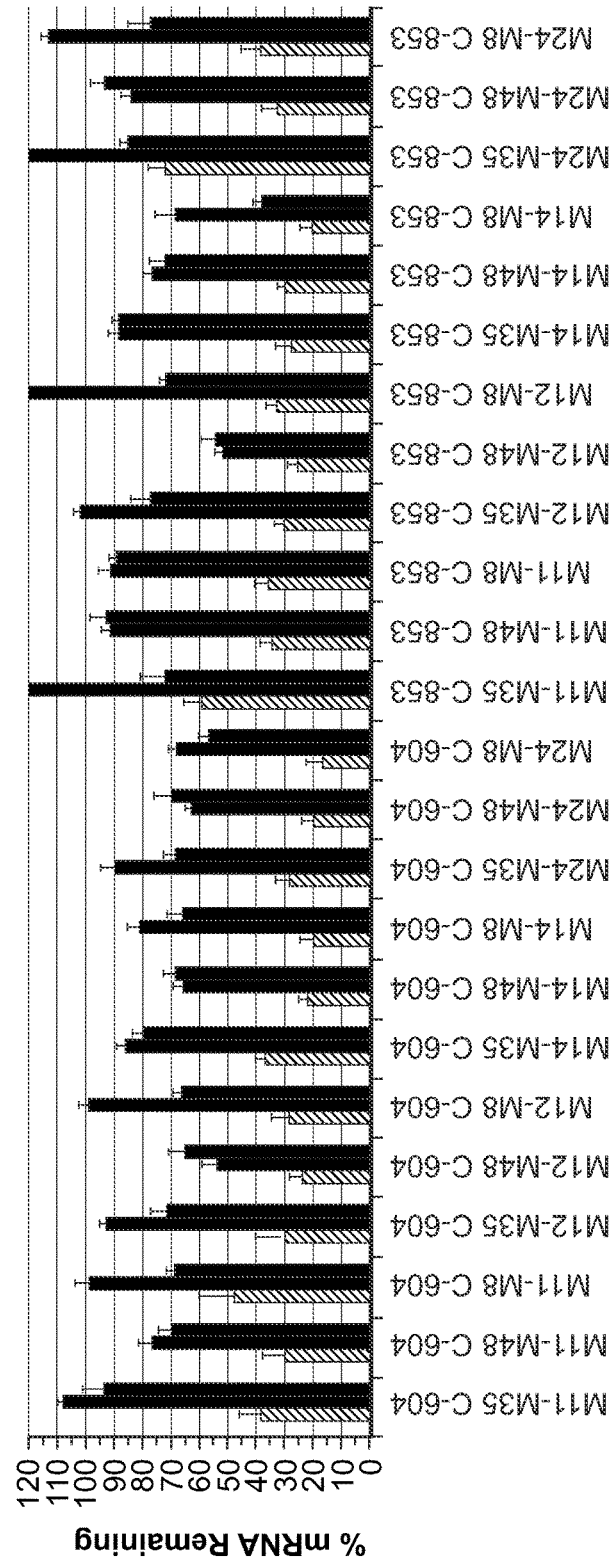
Figures 2, 3, 4, 5, 5B:
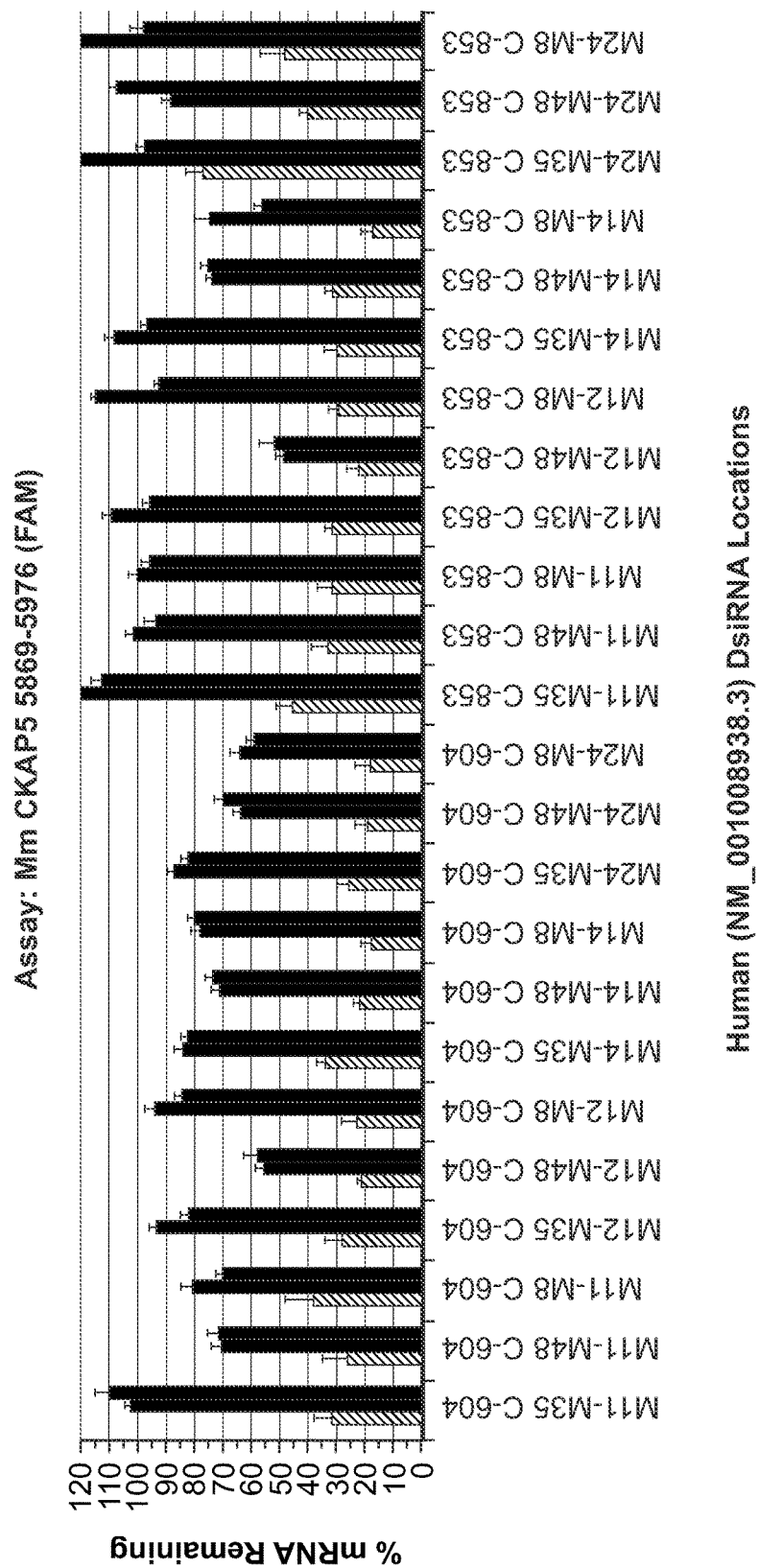
Figures 2, 3, 4, 5, 6, 6A:
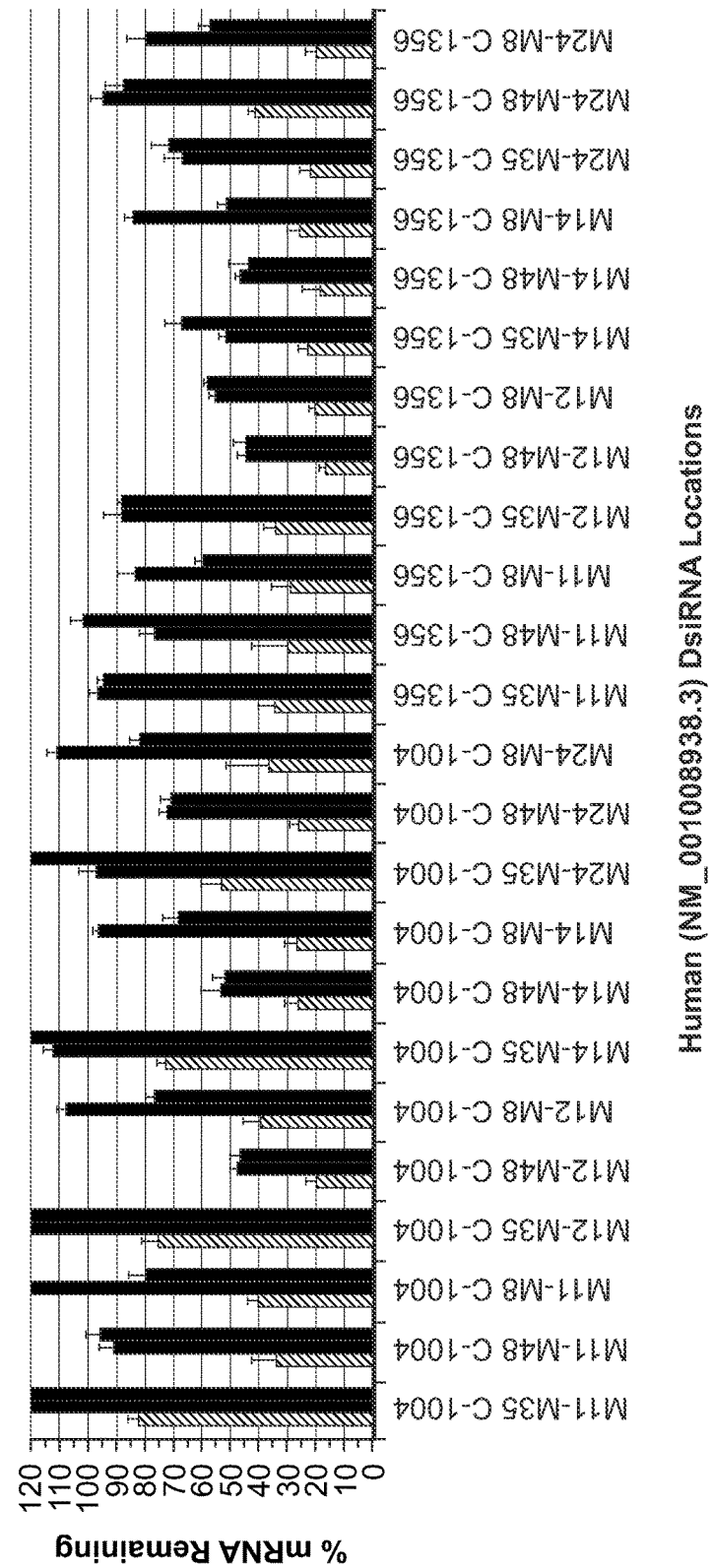
Figures 2, 3, 4, 5, 6, 6B:
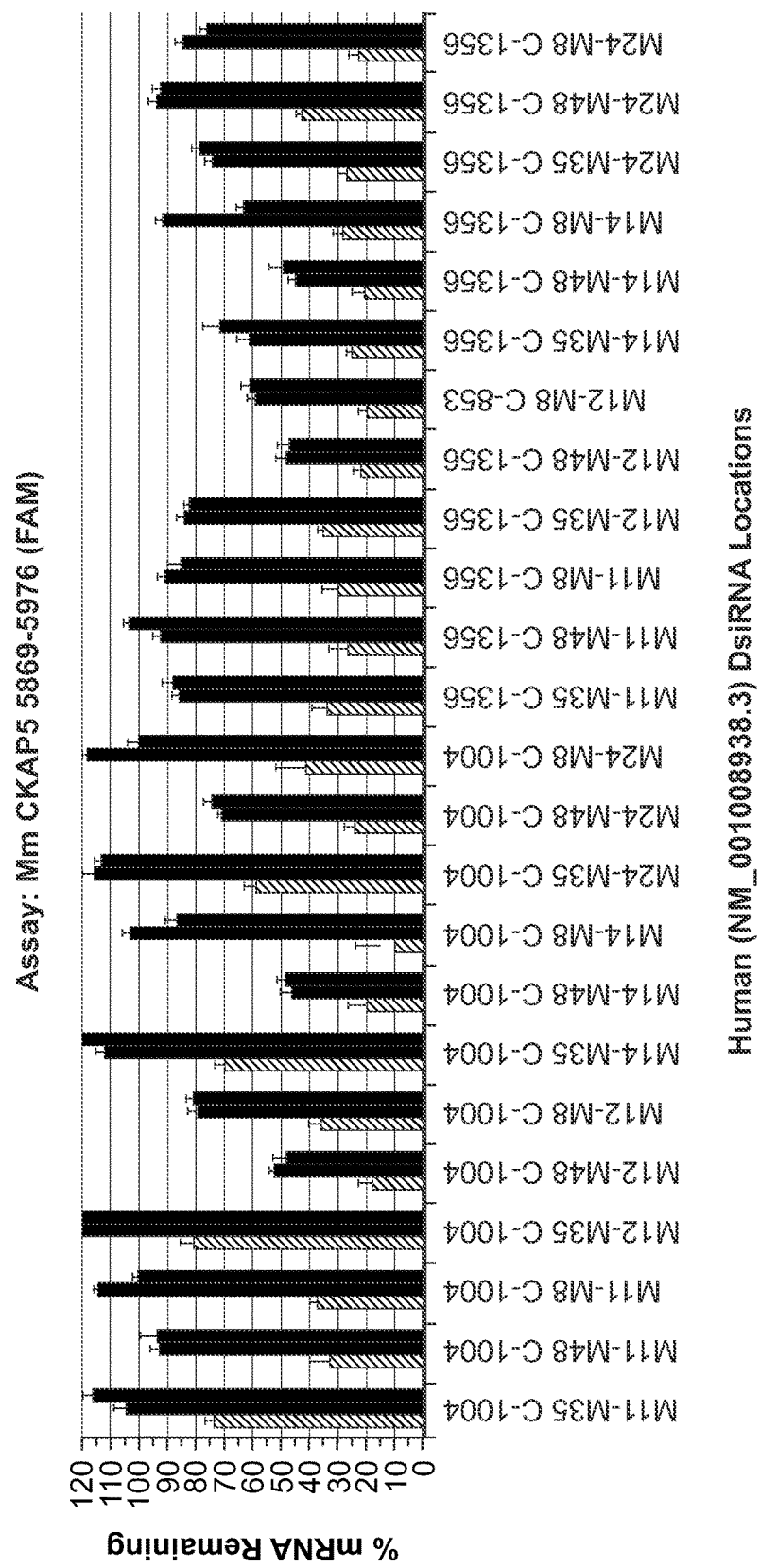
Figures 1A, 3:
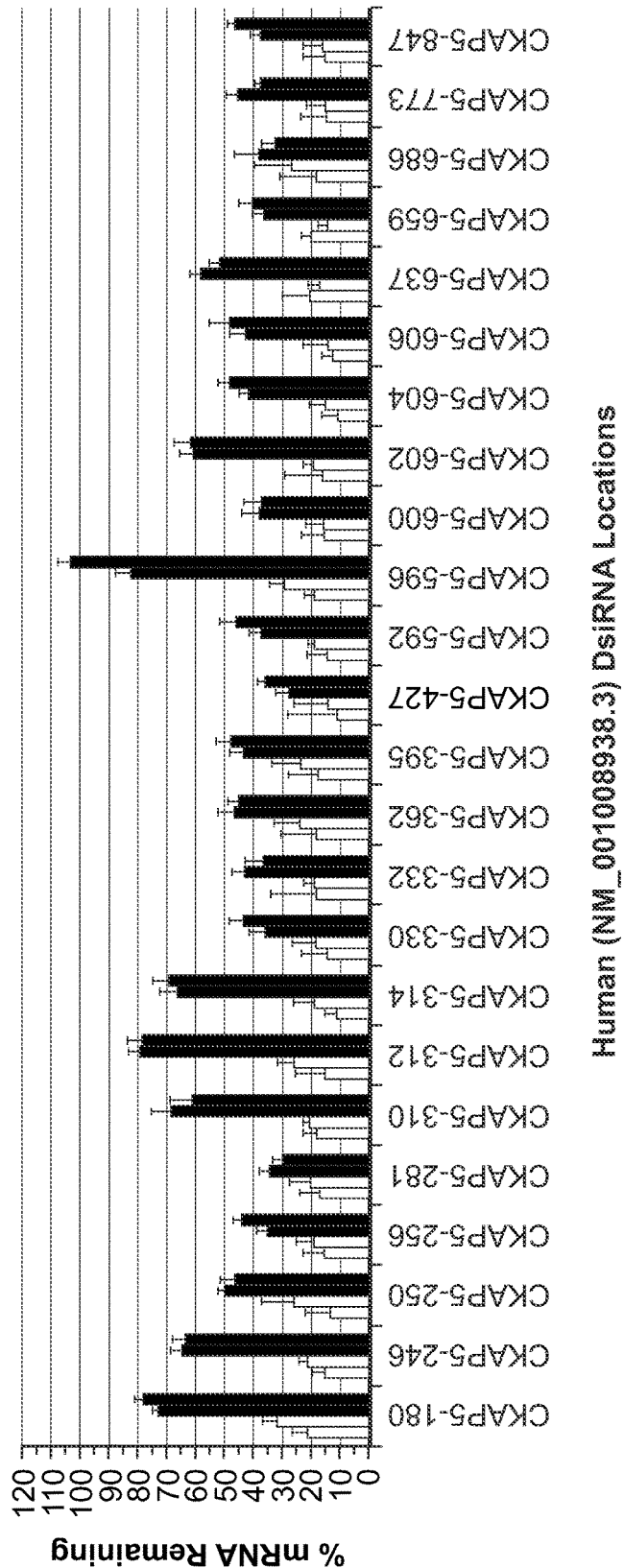
Figures 1B, 3:
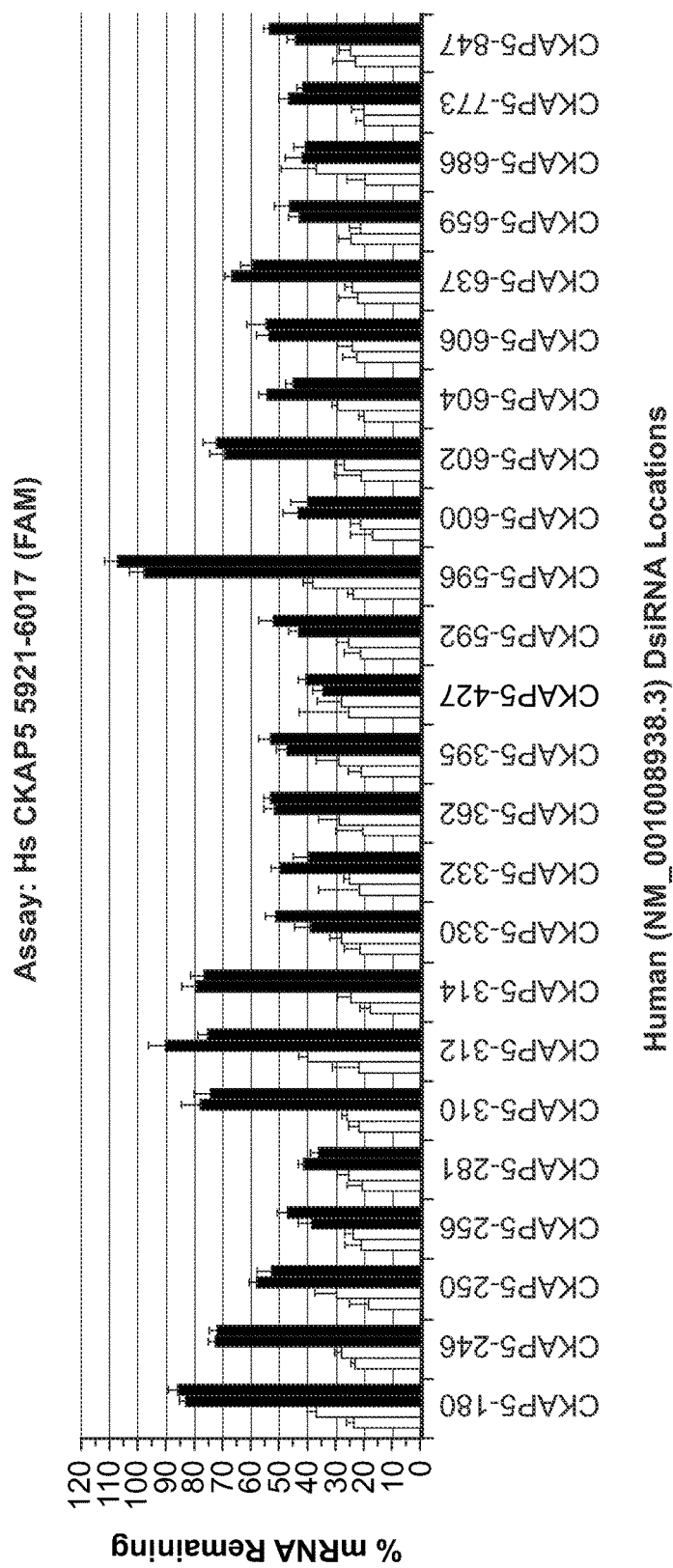
Figures 2A, 3:
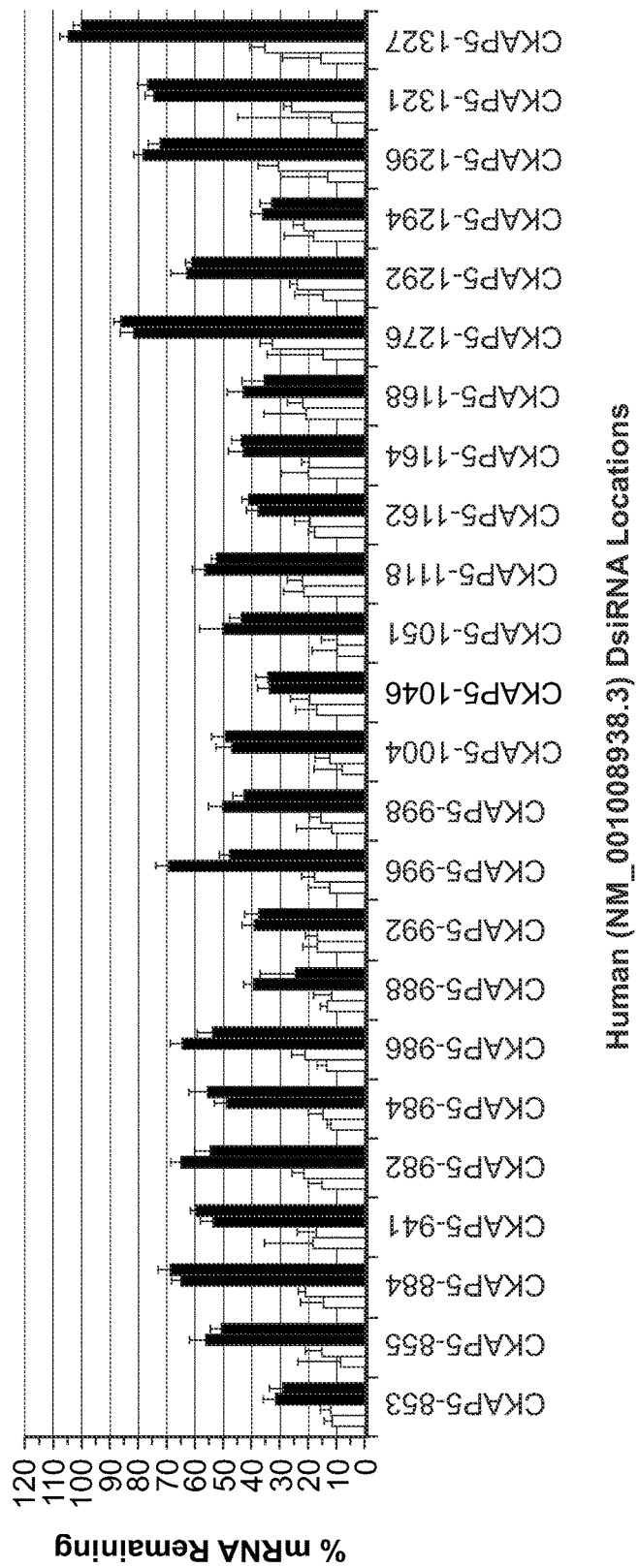
Figures 2B, 3:
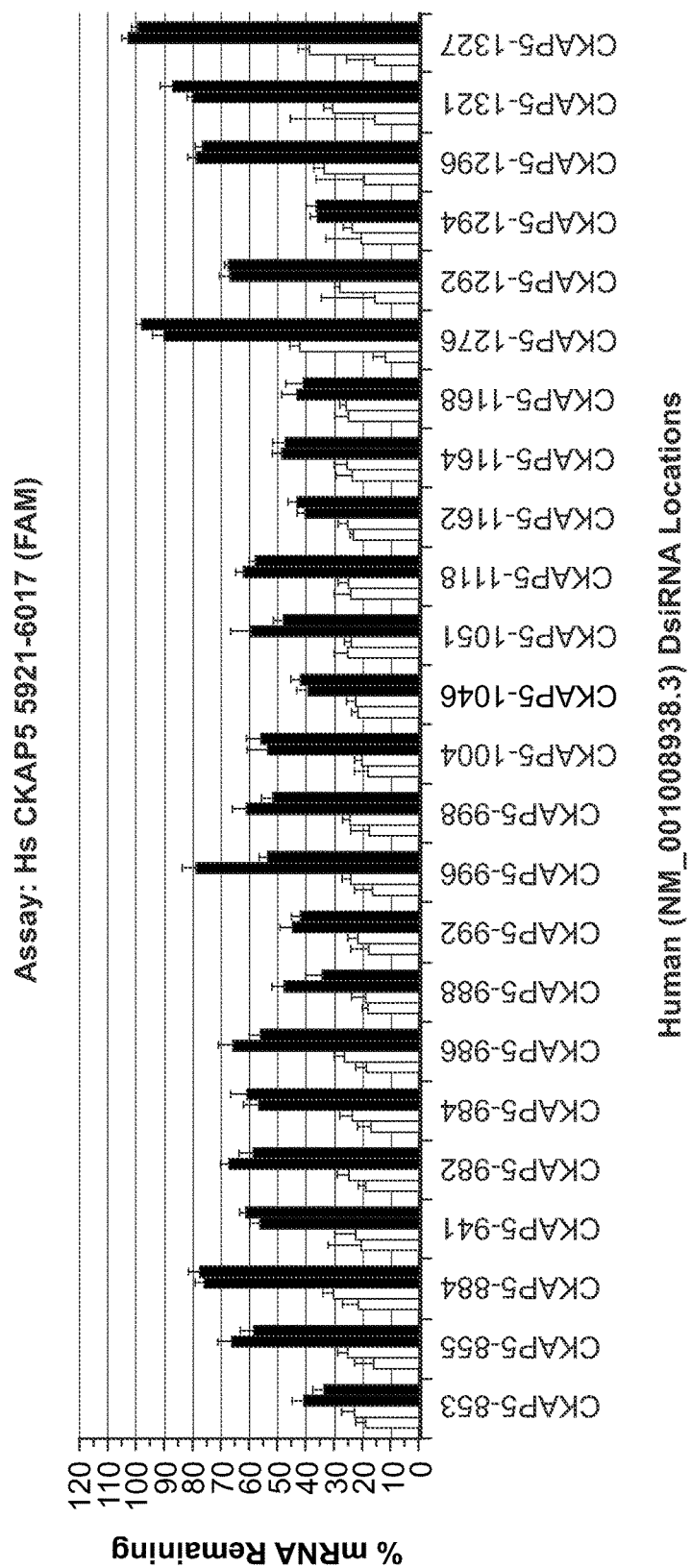
Figures 3, 3A:
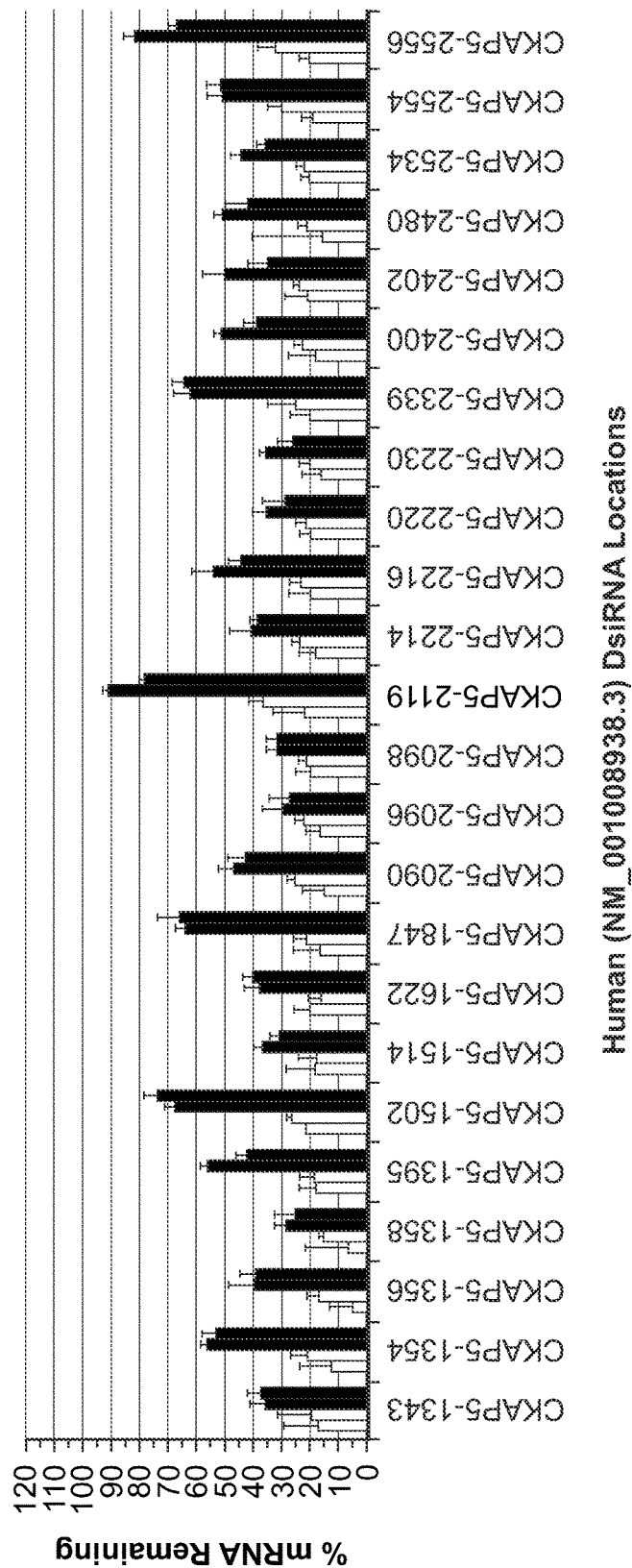
Figures 3, 3B:
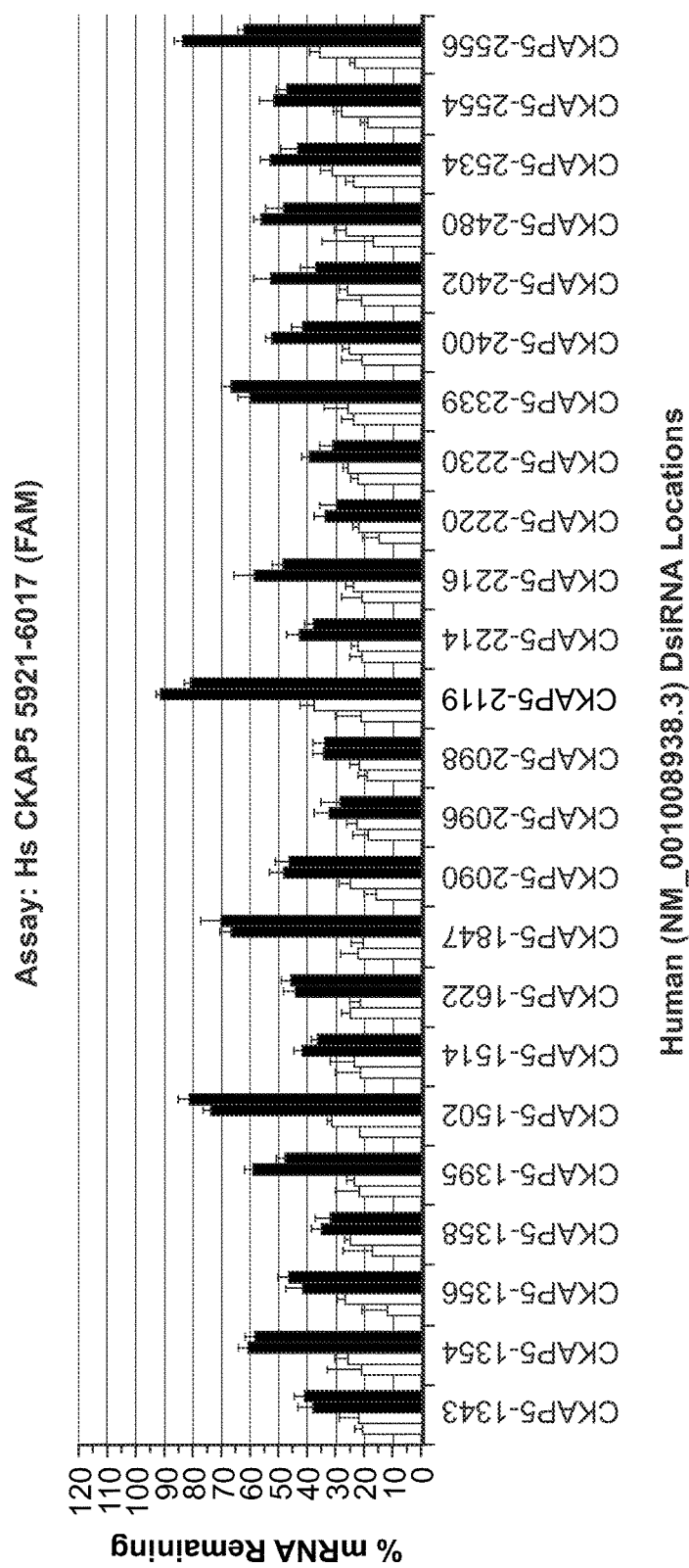
Figures 3, 4, 4A:
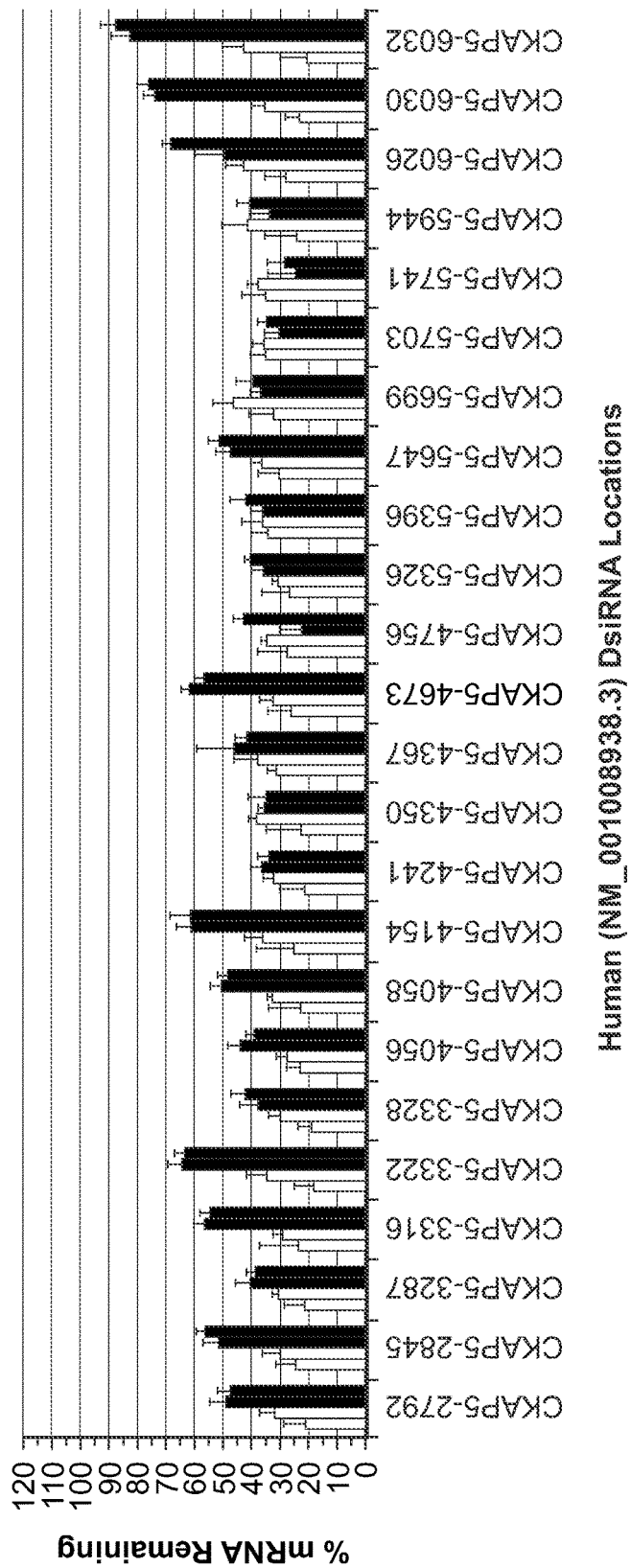
Figures 3, 4, 4B:
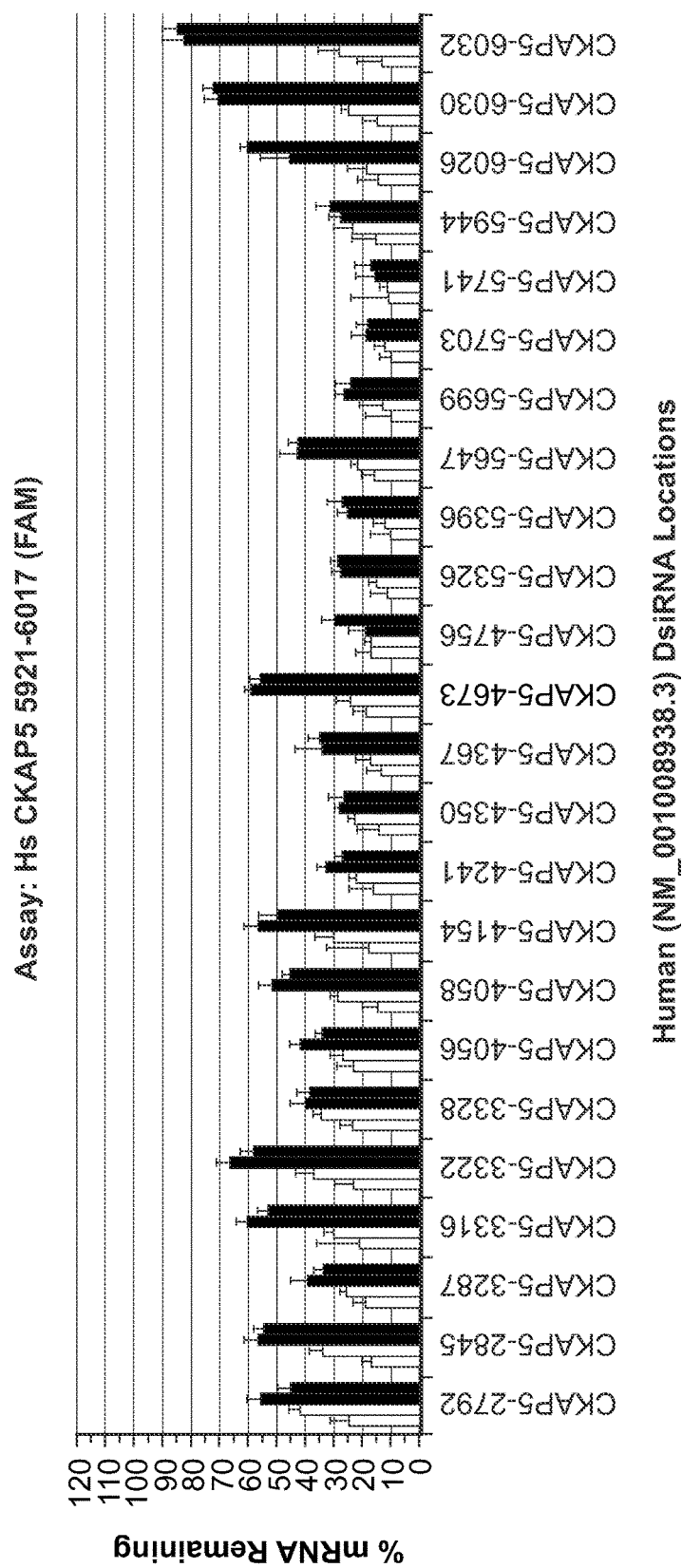
Figures 3, 4, 5, 5A:
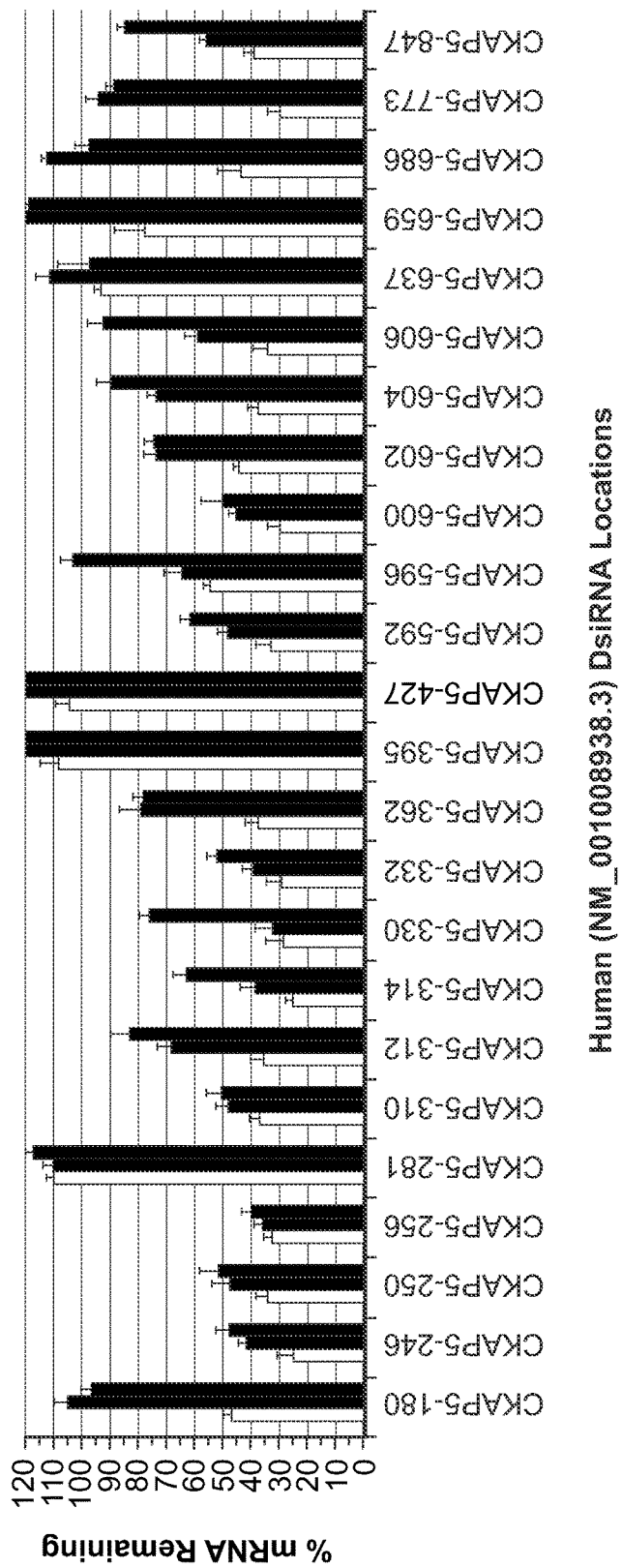
Figures 3, 4, 5, 5B:
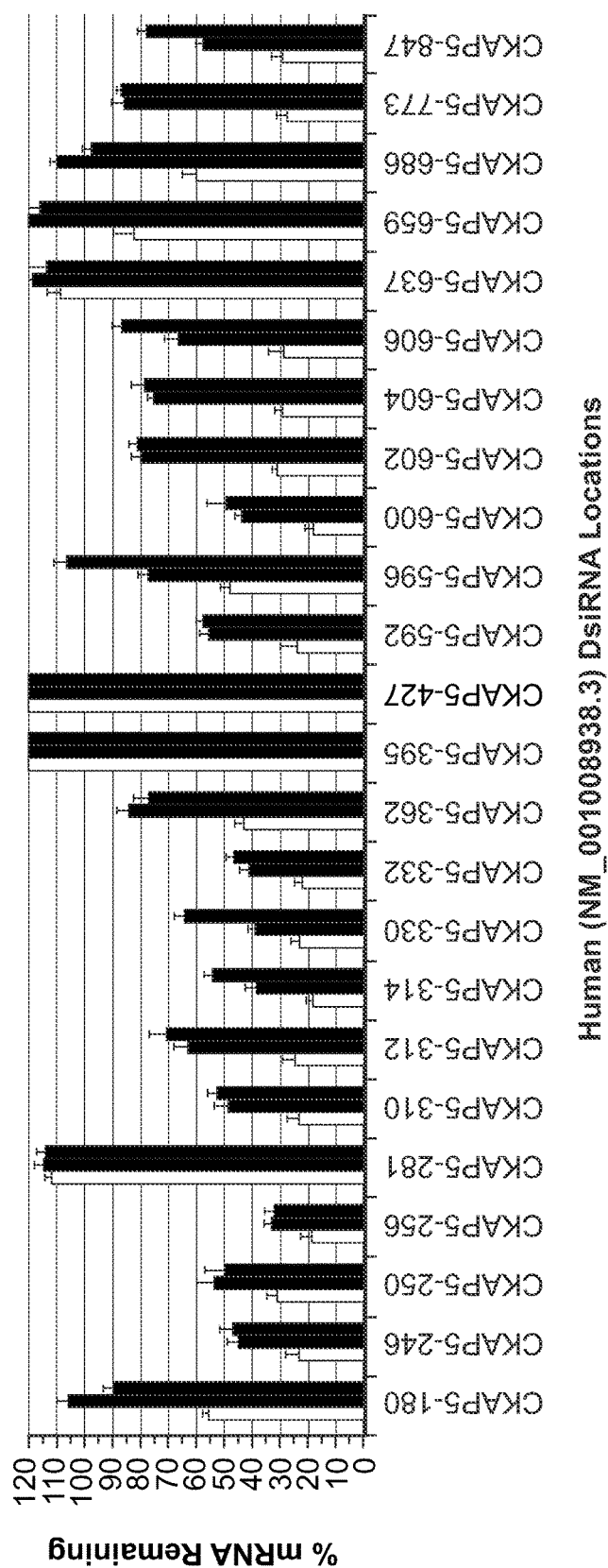
Figures 3, 4, 5, 6, 6A:
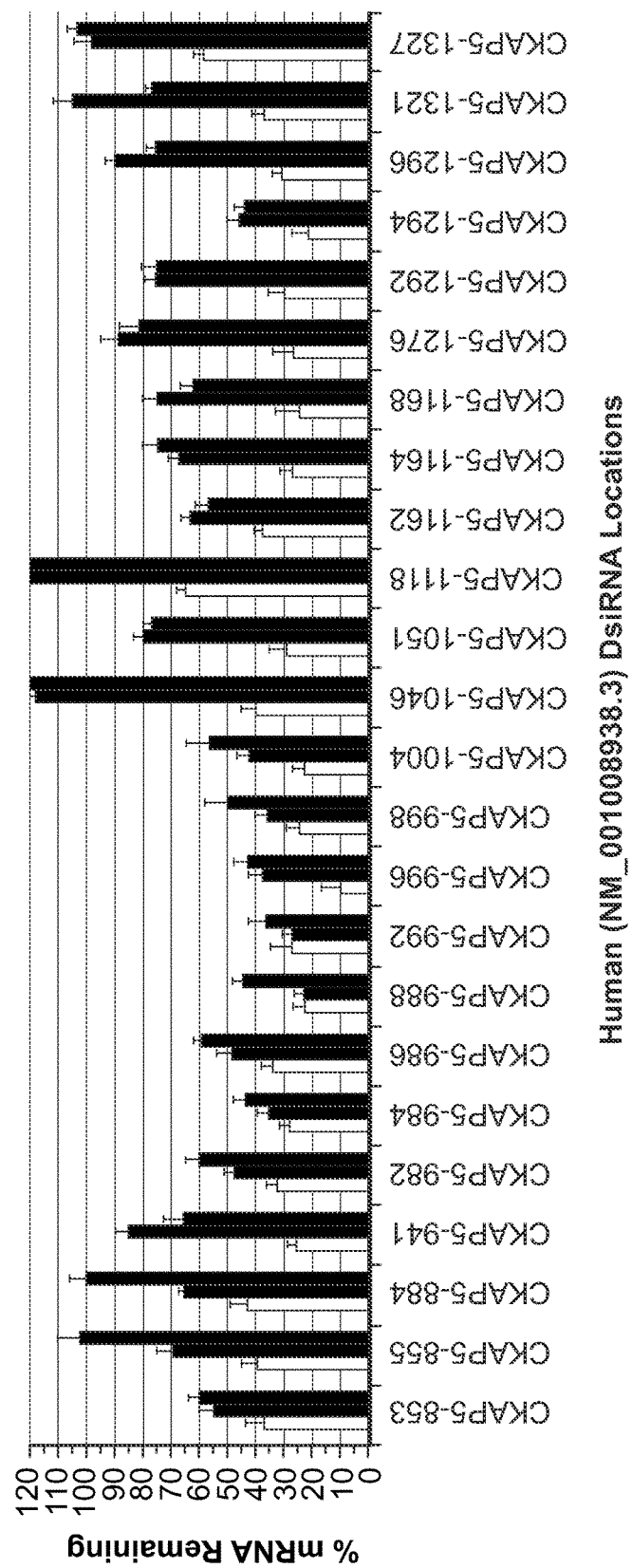
Figures 3, 4, 5, 6, 6B:
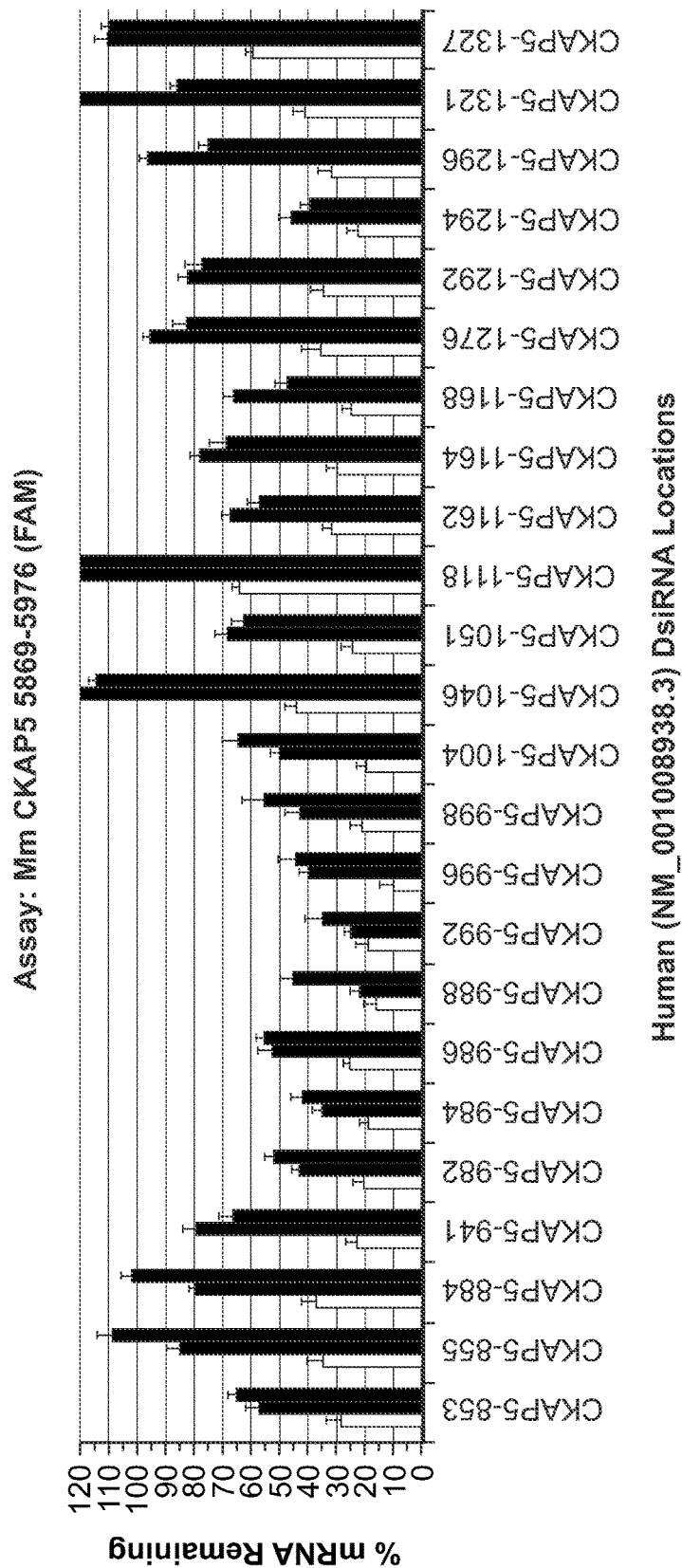
Figures 3, 4, 5, 6, 7, 7A:
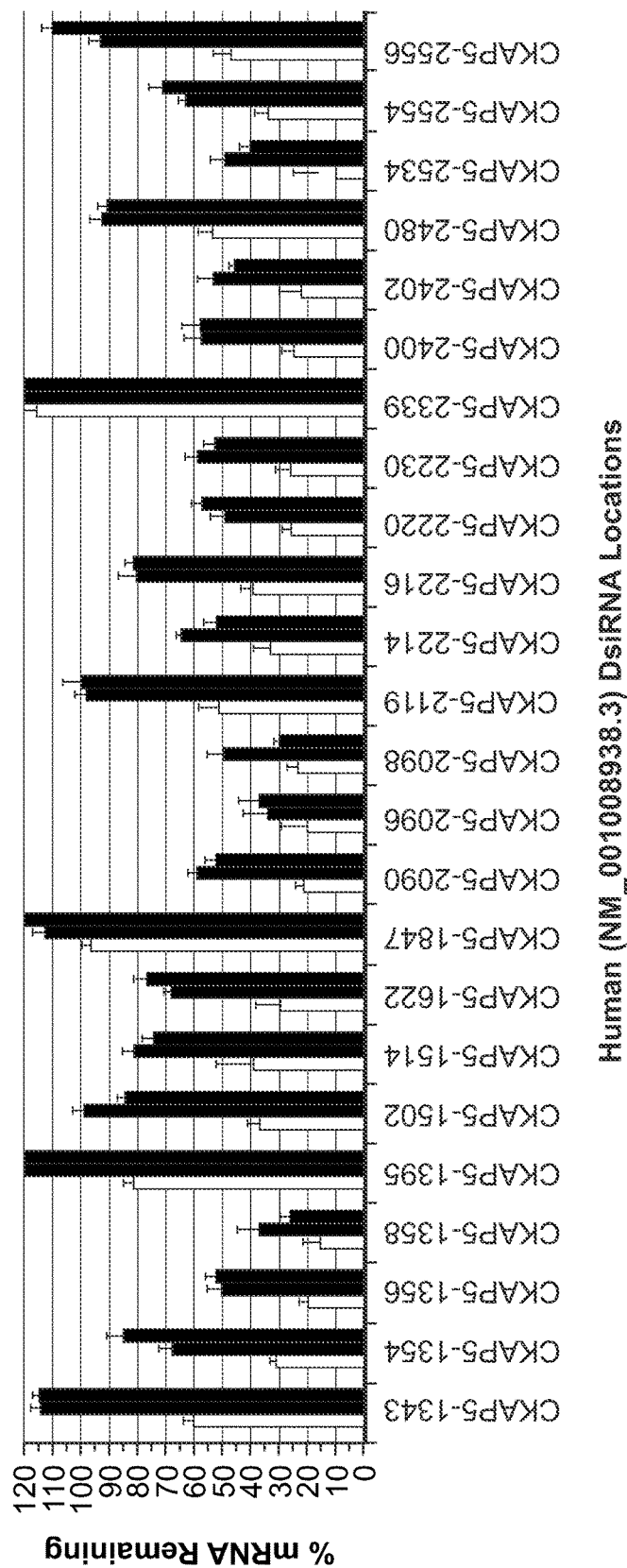
Figures 3, 4, 5, 6, 7, 7B:
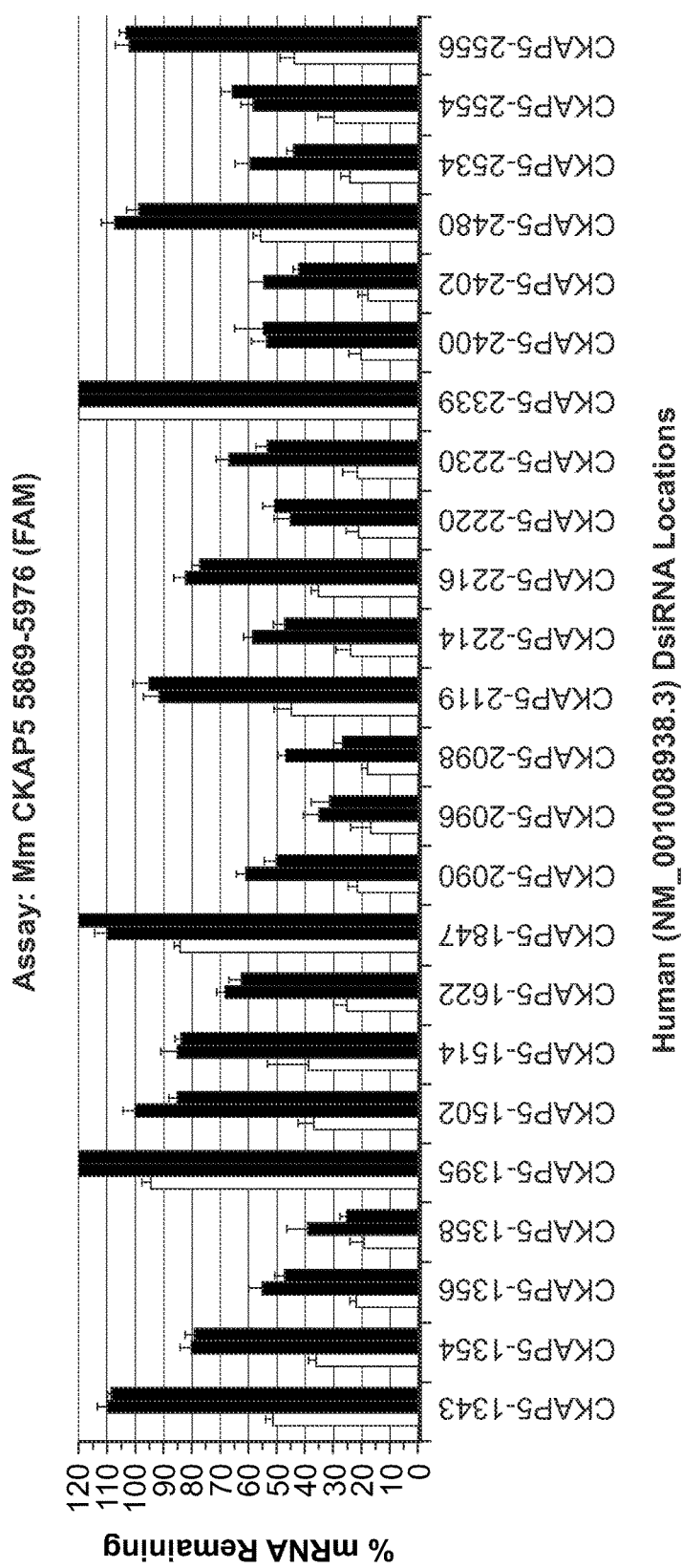
Figures 3, 4, 5, 6, 7, 8, 8A:
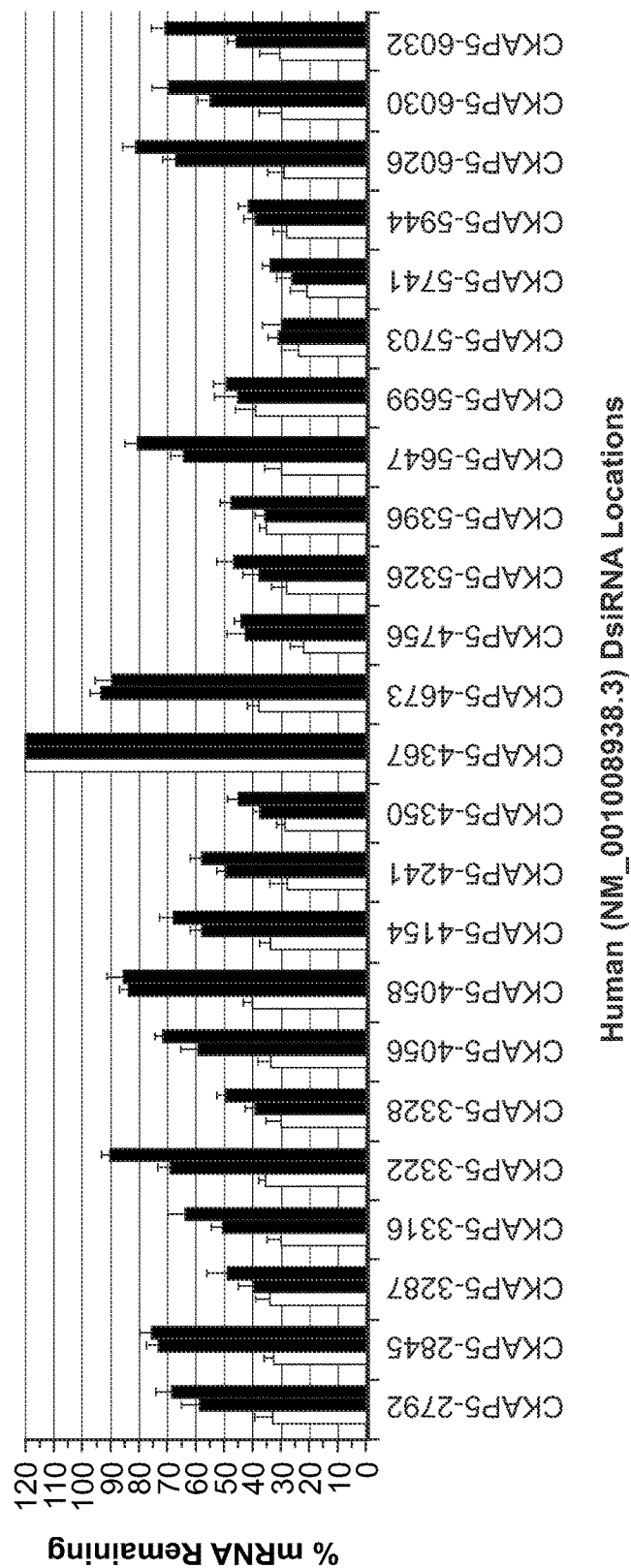
Figures 3, 4, 5, 6, 7, 8, 8B:
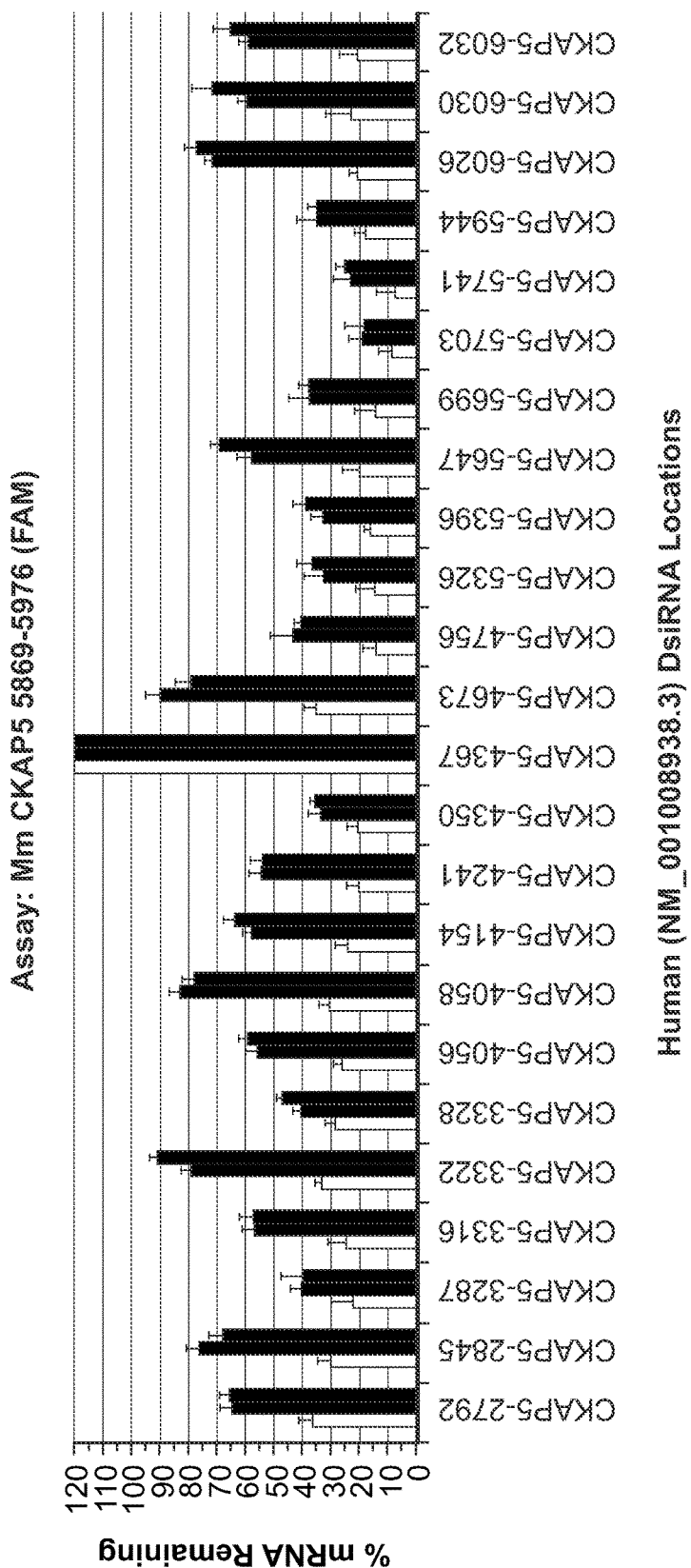

Example 3: Modified Forms of CKAP5-Targeting DsiRNAs Reduce CKAP5 Levels In Vitro—Initial Screen In an initial modification assessment, four DsiRNAs (CKAP5-604, -853, -1004 and -1356) were selected from the above primary screen for investigation of the impact of varying patterns of 2'-O-methyl modifications upon the in vitro activities of such DsiRNAs. Modification patterns employed in this initial modification assessment are shown in FIGS. 2-1 and 2-2, with sense strand modification pattern-antisense strand modification pattern indicated for each DsiRNA tested. FIGS. 2-3 through 2-6 show the results of such experiments, with identities of duplexes CKAP5-604, -853, -1004 and -1356 abbreviated to C-604, C-853, C-1004 and C-1356, respectively. As shown in FIGS. 2-3 and 2-4, DsiRNAs CKAP-604 and -853 tolerated a wide range of modification patterns without impact upon in vitro activity in human HeLa cells, while DsiRNAs CKAP-1004 and -1356 were somewhat less tolerant of extensive 2'-O-methyl modification, though active modified forms of each of these latter sequences were also identified. As shown in FIGS. 2-5 and 2-6, the extent of CKAP5 knockdown in mouse Hepa 1-6 cells was less for each DsiRNA sequence than was observed in human HeLa cells. However, for each duplex sequence examined, at least one DsiRNA having extensive modifications of both sense and antisense strands was identified to possess significant mouse CKAP5 inhibitory activity in vitro.

Example 4: DsiRNA Inhibition of CKAP5—Secondary Screen 96 asymmetric DsiRNAs (22 predicted to be specific for human (Hs) CKAP5 while the remaining 74 were predicted to target both human and mouse (Mm) CKAP5) of the above primary screen experiment were then examined in a secondary assay ("Phase 2"), with results of such assays presented in histogram form in FIGS. 3-1 to 3-8. Specifically, the 96 asymmetric DsiRNAs selected from the 576 tested above were assessed for inhibition of human CKAP5 at 1 nM and 0.1 nM (in duplicate) in the environment of human HeLa cells (FIGS. 3-1 to 3-4). These 96 asymmetric DsiRNAs were also assessed for inhibition of mouse CKAP5 at 1 nM and 0.1 nM (in duplicate) in the environment of mouse Hepa 1-6 cells (FIGS. 3-5 to 3-8). As shown in FIGS. 3-1 to 3-4, a remarkable number of asymmetric DsiRNAs reproducibly exhibited robust human CKAP5 inhibitory efficacies at sub-nanomolar concentrations when assayed in the environment of HeLa cells. In addition, as shown in FIGS. 3-5 to 3-8, a number of these asymmetric DsiRNAs also showed robust mouse CKAP5 inhibitory efficacies at sub-nanomolar concentrations when assayed in the environment of mouse Hepa 1-6 cells (see, e.g., CKAP5-992 and CKAP5-1358, as examples of DsiRNAs that were highly active in both human HeLa cells and in mouse Hepa 1-6 cells). Meanwhile, human CKAP5-specific inhibitory asymmetric DsiRNAs were also identified (see, e.g., CKAP5-395, 427, 637 and 4367 duplexes).

Example 5: Guide Strand-Modified Forms of CKAP5-Targeting DsiRNAs Reduce CKAP5 Levels In Vitro Twenty-four CKAP5-targeting DsiRNAs of the above initial screen (CKAP5-281, -427, -600, -853, -988, -1046, -1294, -1343, -1358, -1514, -2096, -2098, -2214, -2220, -2230, -3287, -3328, -4056, -4350, -4756, -5396, -5699, -5703 and -5741) were prepared with 2'-O-methyl guide strand modification patterns as shown in the schematics of FIG. 4-1 (including unmodified passenger strands and above-described guide strand modification patterns "M8", "M17", "M35" and "M48"). For each of the twenty-four DsiRNA sequences, DsiRNAs possessing each of the four guide strand modification patterns M8, M17, M35 and M48 were assayed for CKAP5 inhibition in human HeLa cells at 1.0 nM and 0.1 nM (in duplicate) concentrations in the environment of the HeLa cells. Results of these experiments are presented as histograms in FIGS. 4-2 to 4-5. These same duplexes were also assayed in mouse Hepa 1-6 cells, with corresponding results shown in FIGS. 4-6 to 4-9. In general, the twenty-four DsiRNA sequences exhibited a trend towards reduced efficacy of CKAP5 inhibition as the extent of 2'-O-methyl modification of the guide strand increased. However, for all DsiRNA sequences examined, a modification pattern could be identified that allowed the DsiRNA to retain significant CKAP5 inhibitory efficacy in vitro. It was also notable that a number of these DsiRNAs (e.g., CKAP5-1046, CKAP5-1343, CKAP5-1358, CKAP5-2096, CKAP5-2214, CKAP5-4056, CKAP5-4350 and CKAP5-5741) exhibited robust CKAP5 inhibitory efficacy in even the most highly modified states examined. Thus, such highly active modified DsiRNA sequences possess modification patterns believed to be capable of stabilizing such DsiRNAs and/or reducing immunogenicity of such DsiRNAs when therapeutically administered to a subject in vivo.

Example 6: Additional Forms of CKAP5-Targeting DsiRNAs Possessing Modifications of Both Guide and Passenger Strands Reduced CKAP5 Levels In Vitro Sixteen CKAP5-targeting DsiRNAs of the above experiments (CKAP5-604, CKAP5-853, CKAP5-1004, CKAP5-1294, CKAP5-1343, CKAP5-1358, CKAP5-2096, CKAP5-2098, CKAP5-2214, CKAP5-3287, CKAP5-4056, CKAP5-4350, CKAP5-4756, CKAP5-5396, CKAP5-5703 and CKAP5-5741) were prepared with 2'-O-methyl passenger strand and guide strand modification patterns as represented above and in FIGS. 5-1 and 5-2 (including the above-described passenger strand modification patterns "SM14", "SM24", "SM31" and "SM12" and guide strand modification patterns "M48", "M8", "M35" and "M17"). For each of the sixteen DsiRNA sequences, DsiRNAs possessing each of the four passenger strand modification patterns M14, M24, M31 and M12 and at least one preferred guide strand modification pattern (selected from among guide strand modification patterns M48, M8, M35 and M17) were assayed for CKAP5 inhibition in human HeLa cells at 1.0 nM and 0.1 nM (in duplicate) concentrations in the environment of the HeLa cells. Results of these experiments are presented as histograms in FIGS. 5-3 to 5-6. For all DsiRNA sequences examined, at least one duplex possessing extensive modification of both guide and passenger strands could be identified that allowed the DsiRNA to retain significant CKAP5 inhibitory efficacy in vitro. It was notable that most of these DsiRNAs (e.g., CKAP5-604, CKAP5-1343, CKAP5-2096, CKAP5-2214, CKAP5-4056, CKAP5-4350 and CKAP5-5741) exhibited robust CKAP5 inhibitory efficacy across all modified states examined. Such highly active modified DsiRNA sequences possess modification patterns believed to be capable of stabilizing such DsiRNAs and/or reducing immunogenicity of such DsiRNAs when therapeutically administered to a subject in vivo.

To assess the potency of modified CKAP5-targeting DsiRNAs further, five modified DsiRNAs (CKAP5-853 M14-M8, CKAP5-1358 M12-M17, CKAP5-2096 M12-M17, CKAP5-4056 M31-M17 and CKAP5-5741 M14-17) were assayed for CKAP5 knockdown at concentrations of 3 nM, 1 nM, 0.1 nM and 0.03 nM in the environment of human HeLa cells. Remarkably, greater than 90% knockdown of CKAP5 levels was observed for all five assayed duplexes at even the lowest concentration tested, 0.03 nM (30 picomolar), at one day post-transfection.

The CKAP5-853 21 nucleotide mRNA target sequence is conserved between mouse and human; however, a "G" residue is found to replace an "A" residue in the macaque sequence at a position corresponding to position 9 from the 5' of the passenger strand (where position 1 is the 5'-terminal residue of the passenger strand) of the CKAP5-853 25/27mer DsiRNA. The effect of this polymorphic residue on the ability of the CKAP5-853 DsiRNA to inhibit CKAP5 in macaque cell lines was examined. Two M. mulatta cell lines (the CMMT mammary gland cell line and the LLC-MK2 derivative kidney cell line) were identified and transfected with not only the CKAP5-853 M14-M8 DsiRNA but also the CKAP5-2096 M12-M17 DsiRNA and the CKAP5-604 M24-M8 DsiRNA. All DsiRNAs were incredibly potent inhibitors of CKAP5 expression, with an IC50 value of 3.1 pM observed for the CKAP5-853 M14-M8 DsiRNA in the macaque CMMT cell line, an IC50 value of 2.3 pM observed for the CKAP5-2096 M12-M17 DsiRNA in the macaque CMMT cell line, and an IC50 value of 5.8 pM observed for the CKAP5-604 M24-M8 DsiRNA in the macaque CMMT cell line.

Example 7: Additional Modified CKAP5 DsiRNAs

The impact upon inhibitory activity of a variety of further guide and passenger strand modification patterns was examined for CKAP5-853 and CKAP5-604 DsiRNAs. Modification patterns used in this Example are shown in FIGS. 6-1 to 6-16, with passenger strand modification patterns shown in FIG. 6-1, guide strand modification patterns shown in FIG. 6-2, combined duplex modification patterns shown in FIGS. 6-3 to 6-14, and modification patterns as applied to the specific CKAP5-853 passenger and guide strands shown in FIG. 6-15. As shown in FIGS. 6-16 through 6-19, many different highly 2'-O-methyl modified CKAP5-853 duplexes possessing remarkably high inhibitory activity and potency were identified. In FIG. 6-19, a CKAP5-targeting duplex harboring a mismatch with respect to the CKAP5 mRNA target sequence ("853-764_mm," which consists of the SEQ ID NO: 5778 passenger strand and the SEQ ID NO: 5789 guide strand) was also assayed for activity, which was somewhat reduced relative to other modified, non-mismatch-containing duplexes. In FIG. 6-20, six additional modified forms of the CKAP5-604 duplex were assayed, and all such forms showed robust inhibitory activities.

Example 8: CKAP5-Targeting DsiRNAs Reduced Growth of Cancer Cell Lines In Vitro

CKAP5-targeting DsiRNAs CKAP5-604 M24-M8 and CKAP5-853 M14-M8 were examined for the property of inhibiting growth of mammalian cancer cells in culture. Both DsiRNAs were observed to dramatically reduce growth (two- to ten-fold or greater reduction of cell growth, as compared to a nonspecific control DsiRNA) of both human HeLa cells in culture and human Hep3B cells in culture. These dramatic growth inhibitory effects were observed even when duplexes were administered at picomolar-range concentrations (30 picomolar or less). Thus, active DsiRNAs targeting CKAP5 were capable of dramatically reducing growth of HeLa and Hep3B cancer cell lines in culture, even at extraordinarily low concentrations.

Similar results were also observed for four additional DsiRNAs (CKAP5-1358 M12-M17, CKAP5-2096 M12-M17, CKAP5-4056 M31-M17 and CKAP5-5741 M14-17) examined for Hep3B growth inhibition. In such experiments, monolayer Hep3B cultured cells were analyzed at four days post-transfection and significant inhibition of Hep3B cell growth (two- to ten-fold or greater reduction of cell growth, as compared to a nonspecific control DsiRNA) was observed at concentrations as low as 30 picomolar or less.

In certain embodiments, double stranded nucleic acids were selected that target the following target sequences in CKAP5 mRNA:

TABLE 8

CKAP5 27 Nucleotide mRNA Target Sequences of Select dsRNAs

| Human CKAP5 Duplex Name | 27 Nucleotide Target Sequence | SEQ ID NO: |
|---|---|---|
| CKAP5-256 | UCCAGAAAAUAAAGGAUGAAAAGAGCC | 3471 |
| CKAP5-281 | CCCAGAGUGGUCCAAAUUUUAGGAUU | 3917 |
| CKAP5-427 | GUGUUGUAAGUAAGGUGUUCAAUCAAC | 3923 |
| CKAP5-600 | AAAGCCUUAAGUGAAUUUGGUUCCAAA | 3497 |
| CKAP5-604 | CCUUAAGUGAAUUUGGUUCCAAAAUCA | 3499 |
| CKAP5-686 | GGCUGUUCGAGAUGAAGCCAAACUAAU | 3929 |
| CKAP5-853 | CCCAACAAGAACUAGAAGCUAAAUUGG | 3507 |
| CKAP5-988 | AACUUCCCAAAGACUUUUAUGACAAAA | 3519 |
| CKAP5-992 | UCCCAAAGACUUUUAUGACAAAAUUGA | 3521 |
| CKAP5-1004 | UUAUGACAAAAUUGAGGCAAAAAAAUG | 3527 |
| CKAP5-1046 | GGCCCUGGAGUCUGUAGAAGUACUAAU | 3937 |
| CKAP5-1162 | UGGCUUUGGCAGCAAAAUGUCUUACUG | 3537 |
| CKAP5-1168 | UGGCAGCAAAAUGUCUUACUGGCCUGG | 3540 |
| CKAP5-1294 | UGCAGGAGGCAAUUGAUGCAAUCUUCC | 3562 |
| CKAP5-1343 | CAGUGAGGAUGUUUUAGCAGUAAUGGA | 3944 |
| CKAP5-1358 | AGCAGUAAUGGAUAAUAAAAAUCCAAC | 3575 |
| CKAP5-1514 | AGUCAGAGAUGCCGCAUUUGAAGCAUU | 3948 |
| CKAP5-2096 | UGGAUGGAAAGAAACUAAUUUUCAGGU | 3596 |
| CKAP5-2098 | GAUGGAAAGAAACUAAUUUUCAGGUGA | 3597 |
| CKAP5-2214 | GACAAGAUUGGAGAUGUGAAAUGUGGG | 3611 |
| CKAP5-2220 | AUUGGAGAUGUGAAAUGUGGGAACAAU | 3614 |
| CKAP5-2230 | UGAAAUGUGGGAACAAUGCAAAAGAAG | 3619 |
| CKAP5-3287 | CAUGAUGCAUUUAGGAUAUGAAAAAAU | 3684 |
| CKAP5-3328 | GGAAACUAAAGCCAACUUCUAAAGAUC | 3695 |
| CKAP5-4056 | AAGGAUGUCAUUCGUAAAGAUGUUCGU | 3720 |
| CKAP5-4241 | CCCAGGAAAAGCCUUAAAGGAAAUAGC | 3740 |
| CKAP5-4350 | CAGGUGUUCAAACUGAUUGGAAAUCUU | 3743 |
| CKAP5-4367 | UGGAAAUCUUUCUGAAAAGGAUAUGAG | 3992 |
| CKAP5-4756 | ACAGUAAUACAGCAUCCACAAUCAAUU | 3768 |
| CKAP5-5326 | AUAGCAUUAACCUAGACAGAAUUCUUC | 3815 |
| CKAP5-5396 | GAAGCAAUGCAAAAGUGAAUUUCCCAU | 3823 |
| CKAP5-5699 | ACUAGCAGAGUUAUAUGAAUAUAAGAA | 3860 |
| CKAP5-5703 | GCAGAGUUAUAUGAAUAUAAGAAGAAA | 3862 |
| CKAP5-5741 | UGACAUUGAACCAUUUCUGAAAAAUUC | 3868 |
| CKAP5-5944 | GGCCAUCUGUCUACUUGGAAAGGCUAA | 3879 |

Select 21 nucleotide CKAP5 mRNA target sequences corresponding to the above double stranded nucleic acids of Table 8 include:

TABLE 9

CKAP5 21 Nucleotide mRNA Target Sequences of Select dsRNAs

| Human CKAP5 Duplex Name | 21 Nucleotide Target Sequence | SEQ ID NO: |
|---|---|---|
| CKAP5-256 | UCCAGAAAAUAAAGGAUGAAA | 2319 |
| CKAP5-281 | CCCAGAGUGGUCCAAAUUUUU | 2765 |
| CKAP5-427 | GUGUUGUAAGUAAGGUGUUCA | 2771 |
| CKAP5-600 | AAAGCCUUAAGUGAAUUUGGU | 2345 |
| CKAP5-604 | CCUUAAGUGAAUUUGGUUCCA | 2347 |
| CKAP5-686 | GGCUGUUCGAGAUGAAGCCAA | 2777 |
| CKAP5-853 | CCCAACAAGAACUAGAAGCUA | 2355 |
| CKAP5-988 | AACUUCCCAAAGACUUUUAUG | 2367 |
| CKAP5-992 | UCCCAAAGACUUUUAUGACAA | 2369 |
| CKAP5-1004 | UUAUGACAAAAUUGAGGCAAA | 2375 |
| CKAP5-1046 | GGCCCUGGAGUCUGUAGAAGU | 2785 |
| CKAP5-1162 | UGGCUUUGGCAGCAAAAUGUC | 2385 |
| CKAP5-1168 | UGGCAGCAAAAUGUCUUACUG | 2388 |
| CKAP5-1294 | UGCAGGAGGCAAUUGAUGCAA | 2410 |
| CKAP5-1343 | CAGUGAGGAUGUUUUAGCAGU | 2792 |
| CKAP5-1358 | AGCAGUAAUGGAUAAUAAAAA | 2423 |
| CKAP5-1514 | AGUCAGAGAUGCCGCAUUUGA | 2796 |
| CKAP5-2096 | UGGAUGGAAAGAAACUAAUUU | 2444 |
| CKAP5-2098 | GAUGGAAAGAAACUAAUUUUC | 2445 |
| CKAP5-2214 | GACAAGAUUGGAGAUGUGAAA | 2459 |
| CKAP5-2220 | AUUGGAGAUGUGAAAUGUGGG | 2462 |
| CKAP5-2230 | UGAAAUGUGGGAACAAUGCAA | 2467 |
| CKAP5-3287 | CAUGAUGCAUUUAGGAUAUGA | 2532 |
| CKAP5-3328 | GGAAACUAAAGCCAACUUCUA | 2543 |
| CKAP5-4056 | AAGGAUGUCAUUCGUAAAGAU | 2568 |
| CKAP5-4241 | CCCAGGAAAAGCCUUAAAGGA | 2588 |
| CKAP5-4350 | CAGGUGUUCAAACUGAUUGGA | 2591 |
| CKAP5-4367 | UGGAAAUCUUUCGAAAAGGA | 2840 |
| CKAP5-4756 | ACAGUAAUACAGCAUCCACAA | 2616 |
| CKAP5-5326 | AUAGCAUUAACCUAGACAGAA | 2663 |
| CKAP5-5396 | GAAGCAAUGCAAAAGUGAAUU | 2671 |
| CKAP5-5699 | ACUAGCAGAGUUAUAUGAAUA | 2708 |
| CKAP5-5703 | GCAGAGUUAUAUGAAUAUAAG | 2710 |
| CKAP5-5741 | UGACAUUGAACCAUUUCUGAA | 2716 |
| CKAP5-5944 | GGCCAUCUGUCUACUUGGAAA | 2727 |

19 nucleotide CKAP5 mRNA target sequences corresponding to the above double stranded nucleic acids of Table 9 include:

TABLE 10

CKAP5 19 Nucleotide mRNA Target Sequences of Select dsRNAs

| Human CKAP5 Duplex Name | 19 Nucleotide Target Sequence | SEQ ID NO: |
|---|---|---|
| CKAP5-256 19nt Target #3 | UCCAGAAAAUAAAGGAUGA | 5199 |
| CKAP5-256 19nt Target #2 | CCAGAAAAUAAAGGAUGAA | 4623 |
| CKAP5-256 19nt Target #1 | CAGAAAAUAAAGGAUGAAA | 4047 |
| CKAP5-281 19nt Target #3 | CCCAGAGUGGUCCAAAUUU | 5645 |
| CKAP5-281 19nt Target #2 | CCAGAGUGGUCCAAAUUUU | 5069 |
| CKAP5-281 19nt Target #1 | CAGAGUGGUCCAAAUUUUU | 4493 |
| CKAP5-427 19nt Target #3 | GUGUUGUAAGUAAGGUGUU | 5651 |
| CKAP5-427 19nt Target #2 | UGUUGUAAGUAAGGUGUUC | 5075 |
| CKAP5-427 19nt Target #1 | GUUGUAAGUAAGGUGUUCA | 4499 |
| CKAP5-600 19nt Target #3 | AAAGCCUUAAGUGAAUUUG | 5225 |
| CKAP5-600 19nt Target #2 | AAGCCUUAAGUGAAUUUGG | 4649 |
| CKAP5-600 19nt Target #1 | AGCCUUAAGUGAAUUUGGU | 4073 |
| CKAP5-604 19nt Target #3 | CCUUAAGUGAAUUUGGUUC | 5227 |
| CKAP5-604 19nt Target #2 | CUUAAGUGAAUUUGGUUCC | 4651 |
| CKAP5-604 19nt Target #1 | UUAAGUGAAUUUGGUUCCA | 4075 |
| CKAP5-686 19nt Target #3 | GGCUGUUCGAGAUGAAGCC | 5657 |
| CKAP5-686 19nt Target #2 | GCUGUUCGAGAUGAAGCCA | 5081 |
| CKAP5-686 19nt Target #1 | CUGUUCGAGAUGAAGCCAA | 4505 |
| CKAP5-853 19nt Target #3 | CCCAACAAGAACUAGAAGC | 5235 |
| CKAP5-853 19nt Target #2 | CCAACAAGAACUAGAAGCU | 4659 |
| CKAP5-853 19nt Target #1 | CAACAAGAACUAGAAGCUA | 4083 |
| CKAP5-988 19nt Target #3 | AACUUCCCAAAGACUUUUA | 5247 |
| CKAP5-988 19nt Target #2 | ACUUCCCAAAGACUUUUAU | 4671 |
| CKAP5-988 19nt Target #1 | CUUCCCAAAGACUUUUAUG | 4095 |
| CKAP5-992 19nt Target #3 | UCCCAAAGACUUUUAUGAC | 5249 |
| CKAP5-992 19nt Target #2 | CCCAAAGACUUUUAUGACA | 4673 |
| CKAP5-992 19nt Target #1 | CCAAAGACUUUUAUGACAA | 4097 |
| CKAP5-1004 19nt Target #3 | UUAUGACAAAAUUGAGGCA | 5255 |
| CKAP5-1004 19nt Target #2 | UAUGACAAAAUUGAGGCAA | 4679 |
| CKAP5-1004 19nt Target #1 | AUGACAAAAUUGAGGCAAA | 4103 |
| CKAP5-1046 19nt Target #3 | GGCCCUGGAGUCUGUAGAA | 5665 |
| CKAP5-1046 19nt Target #2 | GCCCUGGAGUCUGUAGAAG | 5089 |
| CKAP5-1046 19nt Target #1 | CCCUGGAGUCUGUAGAAGU | 4513 |
| CKAP5-1162 19nt Target #3 | UGGCUUUGGCAGCAAAAUG | 5265 |
| CKAP5-1162 19nt Target #2 | GGCUUUGGCAGCAAAAUGU | 4689 |
| CKAP5-1162 19nt Target #1 | GCUUUGGCAGCAAAAUGUC | 4113 |
| CKAP5-1168 19nt Target #3 | UGGCAGCAAAAUGUCUUAC | 5268 |

TABLE 10-continued

CKAP5 19 Nucleotide mRNA Target Sequences of Select dsRNAs

| Human CKAP5 Duplex Name | 19 Nucleotide Target Sequence | SEQ ID NO: |
|---|---|---|
| CKAP5-1168 19nt Target #2 | GGCAGCAAAAUGUCUUACU | 4692 |
| CKAP5-1168 19nt Target #1 | GCAGCAAAAUGUCUUACUG | 4116 |
| CKAP5-1294 19nt Target #3 | UGCAGGAGGCAAUUGAUGC | 5290 |
| CKAP5-1294 19nt Target #2 | GCAGGAGGCAAUUGAUGCA | 4714 |
| CKAP5-1294 19nt Target #1 | CAGGAGGCAAUUGAUGCAA | 4138 |
| CKAP5-1343 19nt Target #3 | CAGUGAGGAUGUUUUAGCA | 5672 |
| CKAP5-1343 19nt Target #2 | AGUGAGGAUGUUUUAGCAG | 5096 |
| CKAP5-1343 19nt Target #1 | GUGAGGAUGUUUUAGCAGU | 4520 |
| CKAP5-1358 19nt Target #3 | AGCAGUAAUGGAUAAUAAA | 5303 |
| CKAP5-1358 19nt Target #2 | GCAGUAAUGGAUAAUAAAA | 4727 |
| CKAP5-1358 19nt Target #1 | CAGUAAUGGAUAAUAAAAA | 4151 |
| CKAP5-1514 19nt Target #3 | AGUCAGAGAUGCCGCAUUU | 5676 |
| CKAP5-1514 19nt Target #2 | GUCAGAGAUGCCGCAUUUG | 5100 |
| CKAP5-1514 19nt Target #1 | UCAGAGAUGCCGCAUUUGA | 4524 |
| CKAP5-2096 19nt Target #3 | UGGAUGGAAAGAAACUAAU | 5324 |
| CKAP5-2096 19nt Target #2 | GGAUGGAAAGAAACUAAUU | 4748 |
| CKAP5-2096 19nt Target #1 | GAUGGAAAGAAACUAAUUU | 4172 |
| CKAP5-2098 19nt Target #3 | GAUGGAAAGAAACUAAUUU | 5325 |
| CKAP5-2098 19nt Target #2 | AUGGAAAGAAACUAAUUUU | 4749 |
| CKAP5-2098 19nt Target #1 | UGGAAAGAAACUAAUUUUC | 4173 |
| CKAP5-2214 19nt Target #3 | GACAAGAUUGGAGAUGUGA | 5339 |
| CKAP5-2214 19nt Target #2 | ACAAGAUUGGAGAUGUGAA | 4763 |
| CKAP5-2214 19nt Target #1 | CAAGAUUGGAGAUGUGAAA | 4187 |
| CKAP5-2220 19nt Target #3 | AUUGGAGAUGUGAAAUGUG | 5342 |
| CKAP5-2220 19nt Target #2 | UUGGAGAUGUGAAAUGUGG | 4766 |
| CKAP5-2220 19nt Target #1 | UGGAGAUGUGAAAUGUGGG | 4190 |
| CKAP5-2230 19nt Target #3 | UGAAAUGUGGGAACAAUGC | 5347 |
| CKAP5-2230 19nt Target #2 | GAAAUGUGGGAACAAUGCA | 4771 |
| CKAP5-2230 19nt Target #1 | AAAUGUGGGAACAAUGCAA | 4195 |
| CKAP5-3287 19nt Target #3 | CAUGAUGCAUUUAGGAUAU | 5412 |
| CKAP5-3287 19nt Target #2 | AUGAUGCAUUUAGGAUAUG | 4836 |
| CKAP5-3287 19nt Target #1 | UGAUGCAUUUAGGAUAUGA | 4260 |
| CKAP5-3328 19nt Target #3 | GGAAACUAAAGCCAACUUC | 5423 |
| CKAP5-3328 19nt Target #2 | GAAACUAAAGCCAACUUCU | 4847 |
| CKAP5-3328 19nt Target #1 | AAACUAAAGCCAACUUCUA | 4271 |
| CKAP5-4056 19nt Target #3 | AAGGAUGUCAUUCGUAAAG | 5448 |
| CKAP5-4056 19nt Target #2 | AGGAUGUCAUUCGUAAAGA | 4872 |
| CKAP5-4056 19nt Target #1 | GGAUGUCAUUCGUAAAGAU | 4296 |
| CKAP5-4241 19nt Target #3 | CCCAGGAAAAGCCUUAAAG | 5468 |
| CKAP5-4241 19nt Target #2 | CCAGGAAAAGCCUUAAAGG | 4892 |
| CKAP5-4241 19nt Target #1 | CAGGAAAAGCCUUAAAGGA | 4316 |
| CKAP5-4350 19nt Target #3 | CAGGUGUUCAAACUGAUUG | 5471 |
| CKAP5-4350 19nt Target #2 | AGGUGUUCAAACUGAUUGG | 4895 |
| CKAP5-4350 19nt Target #1 | GGUGUUCAAACUGAUUGGA | 4319 |
| CKAP5-4367 19nt Target #3 | UGGAAAUCUUUCUGAAAAG | 5720 |
| CKAP5-4367 19nt Target #2 | GGAAAUCUUUCUGAAAAGG | 5144 |
| CKAP5-4367 19nt Target #1 | GAAAUCUUUCUGAAAAGGA | 4568 |
| CKAP5-4756 19nt Target #3 | ACAGUAAUACAGCAUCCAC | 5496 |
| CKAP5-4756 19nt Target #2 | CAGUAAUACAGCAUCCACA | 4920 |
| CKAP5-4756 19nt Target #1 | AGUAAUACAGCAUCCACAA | 4344 |
| CKAP5-5326 19nt Target #3 | AUAGCAUUAACCUAGACAG | 5163 |
| CKAP5-5326 19nt Target #2 | UAGCAUUAACCUAGACAGA | 4587 |
| CKAP5-5326 19nt Target #1 | AGCAUUAACCUAGACAGAA | 4011 |
| CKAP5-5396 19nt Target #3 | GAAGCAAUGCAAAGUGAA | 5551 |
| CKAP5-5396 19nt Target #2 | AAGCAAUGCAAAGUGAAU | 4975 |
| CKAP5-5396 19nt Target #1 | AGCAAUGCAAAGUGAAUU | 4399 |
| CKAP5-5699 19nt Target #3 | ACUAGCAGAGUUAUAUGAA | 5588 |
| CKAP5-5699 19nt Target #2 | CUAGCAGAGUUAUAUGAAU | 5012 |
| CKAP5-5699 19nt Target #1 | UAGCAGAGUUAUAUGAAUA | 4436 |
| CKAP5-5703 19nt Target #3 | GCAGAGUUAUAUGAAUAUA | 5590 |
| CKAP5-5703 19nt Target #2 | CAGAGUUAUAUGAAUAUAA | 5014 |
| CKAP5-5703 19nt Target #1 | AGAGUUAUAUGAAUAUAAG | 4438 |
| CKAP5-5741 19nt Target #3 | UGACAUUGAACCAUUUCUG | 5596 |
| CKAP5-5741 19nt Target #2 | GACAUUGAACCAUUUCUGA | 5020 |
| CKAP5-5741 19nt Target #1 | ACAUUGAACCAUUUCUGAA | 4444 |
| CKAP5-5944 19nt Target #3 | GGCCAUCUGUCUACUUGGA | 5607 |
| CKAP5-5944 19nt Target #2 | GCCAUCUGUCUACUUGGAA | 5031 |
| CKAP5-5944 19nt Target #1 | CCAUCUGUCUACUUGGAAA | 4455 |

Certain selections of 27 nucleotide CKAP5 mRNA targets included the following:

TABLE 11

CKAP5 27 Nucleotide mRNA Target Sequences of Additional Select dsRNAs

| Human CKAP5 Duplex Name | 27 Nucleotide Target Sequence | SEQ ID NO: |
|---|---|---|
| CKAP5-256 | UCCAGAAAAUAAAGGAUGAAAAGAGCC | 3471 |
| CKAP5-281 | CCCAGAGUGGUCCAAAUUUUAGGAUU | 3917 |
| CKAP5-600 | AAAGCCUUAAGUGAAUUUGGUUCCAAA | 3497 |
| CKAP5-604 | CCUUAAGUGAAUUUGGUUCCAAAAUCA | 3499 |
| CKAP5-686 | GGCUGUUCGAGAUGAAGCCAAACUAAU | 3929 |
| CKAP5-992 | UCCCAAAGACUUUUAUGACAAAAUUGA | 3521 |
| CKAP5-1168 | UGGCAGCAAAAUGUCUUACUGGCCUGG | 3540 |
| CKAP5-1294 | UGCAGGAGGCAAUUGAUGCAAUCUUCC | 3562 |
| CKAP5-1358 | AGCAGUAAUGGAUAAUAAAAAUCCAAC | 3575 |
| CKAP5-1514 | AGUCAGAGAUGCCGCAUUUGAAGCAUU | 3948 |
| CKAP5-2096 | UGGAUGGAAAGAAACUAAUUUCAGGU | 3596 |
| CKAP5-2098 | GAUGGAAAGAAACUAAUUUCAGGUGA | 3597 |
| CKAP5-2220 | AUUGGAGAUGUGAAAUGUGGGAACAAU | 3614 |
| CKAP5-2230 | UGAAAUGUGGGAACAAUGCAAAAGAAG | 3619 |
| CKAP5-3328 | GGAAACUAAAGCCAACUUCUAAAGAUC | 3695 |
| CKAP5-4241 | CCCAGGAAAAGCCUUAAAGGAAAUAGC | 3740 |
| CKAP5-4756 | ACAGUAAUACAGCAUCCACAAUCAAUU | 3768 |
| CKAP5-5396 | GAAGCAAUGCAAAAGUGAAUUUCCCAU | 3823 |
| CKAP5-5699 | ACUAGCAGAGUUAUAUGAAUAUAAGAA | 3860 |
| CKAP5-5741 | UGACAUUGAACCAUUUCUGAAAAAUUC | 3868 |

Certain additional selections of 21 nucleotide CKAP5 mRNA targets included the following:

TABLE 12

CKAP5 21 Nucleotide mRNA Target Sequences of Additional Select dsRNAs

| Human CKAP5 Duplex Name | 21 Nucleotide Target Sequence | SEQ ID NO: |
|---|---|---|
| CKAP5-256 | UCCAGAAAAUAAAGGAUGAAA | 2319 |
| CKAP5-281 | CCCAGAGUGGUCCAAAUUUUU | 2765 |
| CKAP5-600 | AAAGCCUUAAGUGAAUUUGGU | 2345 |
| CKAP5-604 | CCUUAAGUGAAUUUGGUUCCA | 2347 |
| CKAP5-686 | GGCUGUUCGAGAUGAAGCCAA | 2777 |
| CKAP5-992 | UCCCAAAGACUUUUAUGACAA | 2369 |
| CKAP5-1168 | UGGCAGCAAAAUGUCUUACUG | 2388 |
| CKAP5-1294 | UGCAGGAGGCAAUUGAUGCAA | 2410 |
| CKAP5-1358 | AGCAGUAAUGGAUAAUAAAAA | 2423 |
| CKAP5-1514 | AGUCAGAGAUGCCGCAUUUGA | 2796 |
| CKAP5-2096 | UGGAUGGAAAGAAACUAAUUU | 2444 |

TABLE 12-continued

CKAP5 21 Nucleotide mRNA Target Sequences of Additional Select dsRNAs

| Human CKAP5 Duplex Name | 21 Nucleotide Target Sequence | SEQ ID NO: |
|---|---|---|
| CKAP5-2098 | GAUGGAAAGAAACUAAUUUUC | 2445 |
| CKAP5-2220 | AUUGGAGAUGUGAAAUGUGGG | 2462 |
| CKAP5-2230 | UGAAAUGUGGGAACAAUGCAA | 2467 |
| CKAP5-3328 | GGAAACUAAAGCCAACUUCUA | 2543 |
| CKAP5-4241 | CCCAGGAAAAGCCUUAAAGGA | 2588 |
| CKAP5-4756 | ACAGUAAUACAGCAUCCACAA | 2616 |
| CKAP5-5396 | GAAGCAAUGCAAAAGUGAAUU | 2671 |
| CKAP5-5699 | ACUAGCAGAGUUAUAUGAAUA | 2708 |
| CKAP5-5741 | UGACAUUGAACCAUUUCUGAA | 2716 |

Certain additional selections of 19 nucleotide CKAP5 mRNA targets included the following:

TABLE 13

CKAP5 19 Nucleotide mRNA Target Sequences of Additional Select dsRNAs

| Human CKAP5 Duplex Name | 19 Nucleotide Target Sequence | SEQ ID NO: |
|---|---|---|
| CKAP5-256 19nt Target #3 | UCCAGAAAAUAAAGGAUGA | 5199 |
| CKAP5-256 19nt Target #2 | CCAGAAAAUAAAGGAUGAA | 4623 |
| CKAP5-256 19nt Target #1 | CAGAAAAUAAAGGAUGAAA | 4047 |
| CKAP5-281 19nt Target #3 | CCCAGAGUGGUCCAAAUUU | 5645 |
| CKAP5-281 19nt Target #2 | CCAGAGUGGUCCAAAUUUU | 5069 |
| CKAP5-281 19nt Target #1 | CAGAGUGGUCCAAAUUUUU | 4493 |
| CKAP5-427 19nt Target #3 | GUGUUGUAAGUAAGGUGUU | 5651 |
| CKAP5-427 19nt Target #2 | UGUUGUAAGUAAGGUGUUC | 5075 |
| CKAP5-600 19nt Target #3 | AAAGCCUUAAGUGAAUUUG | 5225 |
| CKAP5-600 19nt Target #2 | AAGCCUUAAGUGAAUUUGG | 4649 |
| CKAP5-600 19nt Target #1 | AGCCUUAAGUGAAUUUGGU | 4073 |
| CKAP5-604 19nt Target #3 | CCUUAAGUGAAUUUGGUUC | 5227 |
| CKAP5-604 19nt Target #2 | CUUAAGUGAAUUUGGUUCC | 4651 |
| CKAP5-604 19nt Target #1 | UUAAGUGAAUUUGGUUCCA | 4075 |
| CKAP5-686 19nt Target #3 | GGCUGUUCGAGAUGAAGCC | 5657 |
| CKAP5-686 19nt Target #2 | GCUGUUCGAGAUGAAGCCA | 5081 |
| CKAP5-686 19nt Target #1 | CUGUUCGAGAUGAAGCCAA | 4505 |
| CKAP5-992 19nt Target #3 | UCCCAAAGACUUUUAUGAC | 5249 |
| CKAP5-992 19nt Target #2 | CCCAAAGACUUUUAUGACA | 4673 |
| CKAP5-992 19nt Target #1 | CCAAAGACUUUUAUGACAA | 4097 |
| CKAP5-1168 19nt Target #3 | UGGCAGCAAAAUGUCUUAC | 5268 |

TABLE 13-continued

CKAP5 19 Nucleotide mRNA Target Sequences of Additional Select dsRNAs

| Human CKAP5 Duplex Name | 19 Nucleotide Target Sequence | SEQ ID NO: |
|---|---|---|
| CKAP5-1168 19nt Target #2 | GGCAGCAAAAUGUCUUACU | 4692 |
| CKAP5-1168 19nt Target #1 | GCAGCAAAAUGUCUUACUG | 4116 |
| CKAP5-1294 19nt Target #3 | UGCAGGAGGCAAUUGAUGC | 5290 |
| CKAP5-1294 19nt Target #2 | GCAGGAGGCAAUUGAUGCA | 4714 |
| CKAP5-1294 19nt Target #1 | CAGGAGGCAAUUGAUGCAA | 4138 |
| CKAP5-1358 19nt Target #3 | AGCAGUAAUGGAUAAUAAA | 5303 |
| CKAP5-1358 19nt Target #2 | GCAGUAAUGGAUAAUAAAA | 4727 |
| CKAP5-1358 19nt Target #1 | CAGUAAUGGAUAAUAAAAA | 4151 |
| CKAP5-1514 19nt Target #3 | AGUCAGAGAUGCCGCAUUU | 5676 |
| CKAP5-1514 19nt Target #2 | GUCAGAGAUGCCGCAUUUG | 5100 |
| CKAP5-1514 19nt Target #1 | UCAGAGAUGCCGCAUUUGA | 4524 |
| CKAP5-2096 19nt Target #3 | UGGAUGGAAAGAAACUAAU | 5324 |
| CKAP5-2096 19nt Target #2 | GGAUGGAAAGAAACUAAUU | 4748 |
| CKAP5-2096 19nt Target #1 | GAUGGAAAGAAACUAAUUU | 4172 |
| CKAP5-2098 19nt Target #3 | GAUGGAAAGAAACUAAUUU | 5325 |
| CKAP5-2098 19nt Target #2 | AUGGAAAGAAACUAAUUUU | 4749 |
| CKAP5-2098 19nt Target #1 | UGGAAAGAAACUAAUUUUC | 4173 |
| CKAP5-2220 19nt Target #3 | AUUGGAGAUGUGAAAUGUG | 5342 |
| CKAP5-2220 19nt Target #2 | UUGGAGAUGUGAAAUGUGG | 4766 |
| CKAP5-2220 19nt Target #1 | UGGAGAUGUGAAAUGUGGG | 4190 |
| CKAP5-2230 19nt Target #3 | UGAAAUGUGGGAACAAUGC | 5347 |
| CKAP5-2230 19nt Target #2 | GAAAUGUGGGAACAAUGCA | 4771 |
| CKAP5-2230 19nt Target #1 | AAAUGUGGGAACAAUGCAA | 4195 |
| CKAP5-3328 19nt Target #3 | GGAAACUAAAGCCAACUUC | 5423 |
| CKAP5-3328 19nt Target #2 | GAAACUAAAGCCAACUUCU | 4847 |
| CKAP5-3328 19nt Target #1 | AAACUAAAGCCAACUUCUA | 4271 |
| CKAP5-4241 19nt Target #3 | CCCAGGAAAAGCCUUAAAG | 5468 |
| CKAP5-4241 19nt Target #2 | CCAGGAAAAGCCUUAAAGG | 4892 |
| CKAP5-4241 19nt Target #1 | CAGGAAAAGCCUUAAAGGA | 4316 |
| CKAP5-4756 19nt Target #3 | ACAGUAAUACAGCAUCCAC | 5496 |
| CKAP5-4756 19nt Target #2 | CAGUAAUACAGCAUCCACA | 4920 |
| CKAP5-4756 19nt Target #1 | AGUAAUACAGCAUCCACAA | 4344 |
| CKAP5-5396 19nt Target #3 | GAAGCAAUGCAAAAGUGAA | 5551 |
| CKAP5-5396 19nt Target #2 | AAGCAAUGCAAAAGUGAAU | 4975 |
| CKAP5-5396 19nt Target #1 | AGCAAUGCAAAAGUGAAUU | 4399 |
| CKAP5-5699 19nt Target #3 | ACUAGCAGAGUUAUAUGAA | 5588 |
| CKAP5-5699 19nt Target #2 | CUAGCAGAGUUAUAUGAAU | 5012 |
| CKAP5-5699 19nt Target #1 | UAGCAGAGUUAUAUGAAUA | 4436 |
| CKAP5-5741 19nt Target #3 | UGACAUUGAACCAUUUCUG | 5596 |
| CKAP5-5741 19nt Target #2 | GACAUUGAACCAUUUCUGA | 5020 |
| CKAP5-5741 19nt Target #1 | ACAUUGAACCAUUUCUGAA | 4444 |

Further selections of 27 nucleotide CKAP5 mRNA targets included the following:

TABLE 14

CKAP5 27 Nucleotide mRNA Target Sequences of Further Select dsRNAs

| Human CKAP5 Duplex Name | 27 Nucleotide Target Sequence | SEQ ID NO: |
|---|---|---|
| CKAP5-256 | UCCAGAAAAUAAAGGAUGAAAAGAGCC | 3471 |
| CKAP5-281 | CCCAGAGUGGUCCAAAUUUUUAGGAUU | 3917 |
| CKAP5-600 | AAAGCCUUAAGUGAAUUUGGUUCCAAA | 3497 |
| CKAP5-604 | CCUUAAGUGAAUUUGGUUCCAAAAUCA | 3499 |
| CKAP5-686 | GGCUGUUCGAGAUGAAGCCAAACUAAU | 3929 |
| CKAP5-988 | AACUUCCCAAAGACUUUUAUGACAAAA | 3519 |
| CKAP5-992 | UCCCAAAGACUUUUAUGACAAAAUUGA | 3521 |
| CKAP5-1162 | UGGCUUUGGCAGCAAAAUGUCUUACUG | 3537 |
| CKAP5-1168 | UGGCAGCAAAAUGUCUUACUGGCCUGG | 3540 |
| CKAP5-1294 | UGCAGGAGGCAAUUGAUGCAAUCUUCC | 3562 |
| CKAP5-1343 | CAGUGAGGAUGUUUUAGCAGUAAUGGA | 3944 |
| CKAP5-1358 | AGCAGUAAUGGAUAAUAAAAAUCCAAC | 3575 |
| CKAP5-1514 | AGUCAGAGAUGCCGCAUUUGAAGCAUU | 3948 |
| CKAP5-2096 | UGGAUGGAAAGAAACUAAUUUUCAGGU | 3596 |
| CKAP5-2098 | GAUGGAAAGAAACUAAUUUUCAGGUGA | 3597 |
| CKAP5-2220 | AUUGGAGAUGUGAAAUGUGGGAACAAU | 3614 |
| CKAP5-2230 | UGAAAUGUGGGAACAAUGCAAAAGAAG | 3619 |
| CKAP5-3328 | GGAAACUAAAGCCAACUUCUAAAGAUC | 3695 |
| CKAP5-4241 | CCCAGGAAAAGCCUUAAAGGAAAUAGC | 3740 |
| CKAP5-4367 | UGGAAAUCUUUCUGAAAAGGAUAUGAG | 3992 |
| CKAP5-4756 | ACAGUAAUACAGCAUCCACAAUCAAUU | 3768 |
| CKAP5-5396 | GAAGCAAUGCAAAAGUGAAUUUCCCAU | 3823 |
| CKAP5-5699 | ACUAGCAGAGUUAUAUGAAUAUAAGAA | 3860 |
| CKAP5-5703 | GCAGAGUUAUAUGAAUAUAAGAAGAAA | 3862 |

TABLE 14-continued

CKAP5 27 Nucleotide mRNA Target Sequences of Further Select dsRNAs

| Human CKAP5 Duplex Name | 27 Nucleotide Target Sequence | SEQ ID NO: |
|---|---|---|
| CKAP5-5741 | UGACAUUGAACCAUUUCUGAAAAAUUC | 3868 |
| CKAP5-5944 | GGCCAUCUGUCUACUUGGAAAGGCUAA | 3879 |

Further selections of 21 nucleotide CKAP5 mRNA targets included the following:

TABLE 15

CKAP5 21 Nucleotide mRNA Target Sequences of Further Selected dsRNAs

| Human CKAP5 Duplex Name | 21 Nucleotide Target Sequence | SEQ ID NO: |
|---|---|---|
| CKAP5-256 | UCCAGAAAAUAAAGGAUGAAA | 2319 |
| CKAP5-281 | CCCAGAGUGGUCCAAAUUUUU | 2765 |
| CKAP5-427 | GUGUUGUAAGUAAGGUGUUCA | 2771 |
| CKAP5-600 | AAAGCCUUAAGUGAAUUUGGU | 2345 |
| CKAP5-604 | CCUUAAGUGAAUUUGGUUCCA | 2347 |
| CKAP5-686 | GGCUGUUCGAGAUGAAGCCAA | 2777 |
| CKAP5-853 | CCCAACAAGAACUAGAAGCUA | 2355 |
| CKAP5-988 | AACUUCCCAAAGACUUUUAUG | 2367 |
| CKAP5-992 | UCCCAAAGACUUUUAUGACAA | 2369 |
| CKAP5-1046 | GGCCCUGGAGUCUGUAGAAGU | 2785 |
| CKAP5-1162 | UGGCUUUGGCAGCAAAAUGUC | 2385 |
| CKAP5-1168 | UGGCAGCAAAAUGUCUUACUG | 2388 |
| CKAP5-1294 | UGCAGGAGGCAAUUGAUGCAA | 2410 |
| CKAP5-1343 | CAGUGAGGAUGUUUUAGCAGU | 2792 |
| CKAP5-1358 | AGCAGUAAUGGAUAAUAAAAA | 2423 |
| CKAP5-1514 | AGUCAGAGAUGCCGCAUUUGA | 2796 |
| CKAP5-2096 | UGGAUGGAAAGAAACUAAUUU | 2444 |
| CKAP5-2098 | GAUGGAAAGAAACUAAUUUUC | 2445 |
| CKAP5-2220 | AUUGGAGAUGUGAAAUGUGGG | 2462 |
| CKAP5-2230 | UGAAAUGUGGGAACAAUGCAA | 2467 |
| CKAP5-3328 | GGAAACUAAAGCCAACUUCUA | 2543 |
| CKAP5-4241 | CCCAGGAAAAGCCUUAAAGGA | 2588 |
| CKAP5-4350 | CAGGUGUUCAAACUGAUUGGA | 2591 |
| CKAP5-4367 | UGGAAAUCUUUCUGAAAAGGA | 2840 |
| CKAP5-4756 | ACAGUAAUACAGCAUCCACAA | 2616 |
| CKAP5-5326 | AUAGCAUUAACCUAGACAGAA | 2663 |
| CKAP5-5396 | GAAGCAAUGCAAAAGUGAAUU | 2671 |
| CKAP5-5699 | ACUAGCAGAGUUAUAUGAAUA | 2708 |
| CKAP5-5703 | GCAGAGUUAUAUGAAUAUAAG | 2710 |

TABLE 15-continued

CKAP5 21 Nucleotide mRNA Target Sequences of Further Selected dsRNAs

| Human CKAP5 Duplex Name | 21 Nucleotide Target Sequence | SEQ ID NO: |
|---|---|---|
| CKAP5-5741 | UGACAUUGAACCAUUUCUGAA | 2716 |
| CKAP5-5944 | GGCCAUCUGUCUACUUGGAAA | 2727 |

Further selections of 19 nucleotide CKAP5 mRNA targets included the following:

TABLE 16

CKAP5 19 Nucleotide mRNA Target Sequences of Further Selected dsRNAs

| Human CKAP5 Duplex Name | 19 Nucleotide Target Sequence | SEQ ID NO: |
|---|---|---|
| CKAP5-256 19nt Target #3 | UCCAGAAAAUAAAGGAUGA | 5199 |
| CKAP5-256 19nt Target #2 | CCAGAAAAUAAAGGAUGAA | 4623 |
| CKAP5-256 19nt Target #1 | CAGAAAAUAAAGGAUGAAA | 4047 |
| CKAP5-281 19nt Target #3 | CCCAGAGUGGUCCAAAUUU | 5645 |
| CKAP5-281 19nt Target #2 | CCAGAGUGGUCCAAAUUUU | 5069 |
| CKAP5-281 19nt Target #1 | CAGAGUGGUCCAAAUUUUU | 4493 |
| CKAP5-427 19nt Target #3 | GUGUUGUAAGUAAGGUGUU | 5651 |
| CKAP5-427 19nt Target #2 | UGUUGUAAGUAAGGUGUUC | 5075 |
| CKAP5-427 19nt Target #1 | GUUGUAAGUAAGGUGUUCA | 4499 |
| CKAP5-600 19nt Target #3 | AAAGCCUUAAGUGAAUUUG | 5225 |
| CKAP5-600 19nt Target #2 | AAGCCUUAAGUGAAUUUGG | 4649 |
| CKAP5-600 19nt Target #1 | AGCCUUAAGUGAAUUUGGU | 4073 |
| CKAP5-604 19nt Target #3 | CCUUAAGUGAAUUUGGUUC | 5227 |
| CKAP5-604 19nt Target #2 | CUUAAGUGAAUUUGGUUCC | 4651 |
| CKAP5-604 19nt Target #1 | UUAAGUGAAUUUGGUUCCA | 4075 |
| CKAP5-686 19nt Target #3 | GGCUGUUCGAGAUGAAGCC | 5657 |
| CKAP5-686 19nt Target #2 | GCUGUUCGAGAUGAAGCCA | 5081 |
| CKAP5-686 19nt Target #1 | CUGUUCGAGAUGAAGCCAA | 4505 |
| CKAP5-853 19nt Target #3 | CCCAACAAGAACUAGAAGC | 5235 |
| CKAP5-853 19nt Target #2 | CCAACAAGAACUAGAAGCU | 4659 |
| CKAP5-853 19nt Target #1 | CAACAAGAACUAGAAGCUA | 4083 |
| CKAP5-988 19nt Target #3 | AACUUCCCAAAGACUUUUA | 5247 |
| CKAP5-988 19nt Target #2 | ACUUCCCAAAGACUUUUAU | 4671 |
| CKAP5-988 19nt Target #1 | CUUCCCAAAGACUUUUAUG | 4095 |
| CKAP5-992 19nt Target #3 | UCCCAAAGACUUUUAUGAC | 5249 |
| CKAP5-992 19nt Target #2 | CCCAAAGACUUUUAUGACA | 4673 |
| CKAP5-992 19nt Target #1 | CCAAAGACUUUUAUGACAA | 4097 |
| CKAP5-1004 19nt Target #3 | UUAUGACAAAAUUGAGGCA | 5255 |

TABLE 16-continued

CKAP5 19 Nucleotide mRNA Target Sequences of Further Selected dsRNAs

| Human CKAP5 Duplex Name | 19 Nucleotide Target Sequence | SEQ ID NO: |
|---|---|---|
| CKAP5-1004 19nt Target #2 | UAUGACAAAAUUGAGGCAA | 4679 |
| CKAP5-1046 19nt Target #3 | GGCCCUGGAGUCUGUAGAA | 5665 |
| CKAP5-1046 19nt Target #2 | GCCCUGGAGUCUGUAGAAG | 5089 |
| CKAP5-1046 19nt Target #1 | CCCUGGAGUCUGUAGAAGU | 4513 |
| CKAP5-1162 19nt Target #3 | UGGCUUUGGCAGCAAAAUG | 5265 |
| CKAP5-1162 19nt Target #2 | GGCUUUGGCAGCAAAAUGU | 4689 |
| CKAP5-1162 19nt Target #1 | GCUUUGGCAGCAAAAUGUC | 4113 |
| CKAP5-1168 19nt Target #3 | UGGCAGCAAAAUGUCUUAC | 5268 |
| CKAP5-1168 19nt Target #2 | GGCAGCAAAAUGUCUUACU | 4692 |
| CKAP5-1168 19nt Target #1 | GCAGCAAAAUGUCUUACUG | 4116 |
| CKAP5-1294 19nt Target #3 | UGCAGGAGGCAAUUGAUGC | 5290 |
| CKAP5-1294 19nt Target #2 | GCAGGAGGCAAUUGAUGCA | 4714 |
| CKAP5-1294 19nt Target #1 | CAGGAGGCAAUUGAUGCAA | 4138 |
| CKAP5-1343 19nt Target #3 | CAGUGAGGAUGUUUUAGCA | 5672 |
| CKAP5-1343 19nt Target #2 | AGUGAGGAUGUUUUAGCAG | 5096 |
| CKAP5-1343 19nt Target #1 | GUGAGGAUGUUUUAGCAGU | 4520 |
| CKAP5-1358 19nt Target #3 | AGCAGUAAUGGAUAAUAAA | 5303 |
| CKAP5-1358 19nt Target #2 | GCAGUAAUGGAUAAUAAAA | 4727 |
| CKAP5-1358 19nt Target #1 | CAGUAAUGGAUAAUAAAAA | 4151 |
| CKAP5-1514 19nt Target #3 | AGUCAGAGAUGCCGCAUUU | 5676 |
| CKAP5-1514 19nt Target #2 | GUCAGAGAUGCCGCAUUUG | 5100 |
| CKAP5-1514 19nt Target #1 | UCAGAGAUGCCGCAUUUGA | 4524 |
| CKAP5-2096 19nt Target #3 | UGGAUGGAAAGAAACUAAU | 5324 |
| CKAP5-2096 19nt Target #2 | GGAUGGAAAGAAACUAAUU | 4748 |
| CKAP5-2096 19nt Target #1 | GAUGGAAAGAAACUAAUUU | 4172 |
| CKAP5-2098 19nt Target #3 | GAUGGAAAGAAACUAAUUU | 5325 |
| CKAP5-2098 19nt Target #2 | AUGGAAAGAAACUAAUUUU | 4749 |
| CKAP5-2098 19nt Target #1 | UGGAAAGAAACUAAUUUUC | 4173 |
| CKAP5-2214 19nt Target #3 | GACAAGAUUGGAGAUGUGA | 5339 |
| CKAP5-2214 19nt Target #2 | ACAAGAUUGGAGAUGUGAA | 4763 |
| CKAP5-2220 19nt Target #3 | AUUGGAGAUGUGAAAUGUG | 5342 |
| CKAP5-2220 19nt Target #2 | UUGGAGAUGUGAAAUGUGG | 4766 |
| CKAP5-2220 19nt Target #1 | UGGAGAUGUGAAAUGUGGG | 4190 |
| CKAP5-2230 19nt Target #3 | UGAAAUGUGGGAACAAUGC | 5347 |
| CKAP5-2230 19nt Target #2 | GAAAUGUGGGAACAAUGCA | 4771 |
| CKAP5-2230 19nt Target #1 | AAAUGUGGGAACAAUGCAA | 4195 |
| CKAP5-3328 19nt Target #3 | GGAAACUAAAGCCAACUUC | 5423 |
| CKAP5-3328 19nt Target #2 | GAAACUAAAGCCAACUUCU | 4847 |
| CKAP5-3328 19nt Target #1 | AAACUAAAGCCAACUUCUA | 4271 |
| CKAP5-4241 19nt Target #3 | CCCAGGAAAAGCCUUAAAG | 5468 |
| CKAP5-4241 19nt Target #2 | CCAGGAAAAGCCUUAAAGG | 4892 |
| CKAP5-4241 19nt Target #1 | CAGGAAAAGCCUUAAAGGA | 4316 |
| CKAP5-4350 19nt Target #3 | CAGGUGUUCAAACUGAUUG | 5471 |
| CKAP5-4350 19nt Target #2 | AGGUGUUCAAACUGAUUGG | 4895 |
| CKAP5-4350 19nt Target #1 | GGUGUUCAAACUGAUUGGA | 4319 |
| CKAP5-4367 19nt Target #3 | UGGAAAUCUUUCUGAAAAG | 5720 |
| CKAP5-4367 19nt Target #2 | GGAAAUCUUUCUGAAAAGG | 5144 |
| CKAP5-4367 19nt Target #1 | GAAAUCUUUCUGAAAAGGA | 4568 |
| CKAP5-4756 19nt Target #3 | ACAGUAAUACAGCAUCCAC | 5496 |
| CKAP5-4756 19nt Target #2 | CAGUAAUACAGCAUCCACA | 4920 |
| CKAP5-4756 19nt Target #1 | AGUAAUACAGCAUCCACAA | 4344 |
| CKAP5-5326 19nt Target #3 | AUAGCAUUAACCUAGACAG | 5163 |
| CKAP5-5326 19nt Target #2 | UAGCAUUAACCUAGACAGA | 4587 |
| CKAP5-5326 19nt Target #1 | AGCAUUAACCUAGACAGAA | 4011 |
| CKAP5-5396 19nt Target #3 | GAAGCAAUGCAAAAGUGAA | 5551 |
| CKAP5-5396 19nt Target #2 | AAGCAAUGCAAAAGUGAAU | 4975 |
| CKAP5-5396 19nt Target #1 | AGCAAUGCAAAAGUGAAUU | 4399 |
| CKAP5-5699 19nt Target #3 | ACUAGCAGAGUUAUAUGAA | 5588 |
| CKAP5-5699 19nt Target #2 | CUAGCAGAGUUAUAUGAAU | 5012 |
| CKAP5-5699 19nt Target #1 | UAGCAGAGUUAUAUGAAUA | 4436 |
| CKAP5-5703 19nt Target #3 | GCAGAGUUAUAUGAAUAUA | 5590 |
| CKAP5-5703 19nt Target #2 | CAGAGUUAUAUGAAUAUAA | 5014 |
| CKAP5-5703 19nt Target #1 | AGAGUUAUAUGAAUAUAAG | 4438 |
| CKAP5-5741 19nt Target #3 | UGACAUUGAACCAUUUCUG | 5596 |
| CKAP5-5741 19nt Target #2 | GACAUUGAACCAUUUCUGA | 5020 |
| CKAP5-5741 19nt Target #1 | ACAUUGAACCAUUUCUGAA | 4444 |
| CKAP5-5944 19nt Target #3 | GGCCAUCUGUCUACUUGGA | 5607 |
| CKAP5-5944 19nt Target #2 | GCCAUCUGUCUACUUGGAA | 5031 |
| CKAP5-5944 19nt Target #1 | CCAUCUGUCUACUUGGAAA | 4455 |

More selections of 27 nucleotide CKAP5 mRNA targets included the following:

TABLE 17

CKAP5 27 Nucleotide mRNA Target Sequences of More Select dsRNAs

| Human CKAP5 Duplex Name | 27 Nucleotide Target Sequence | SEQ ID NO: |
|---|---|---|
| CKAP5-256 | UCCAGAAAAUAAAGGAUGAAAAGAGCC | 3471 |
| CKAP5-281 | CCCAGAGUGGUCCAAAUUUUAGGAUU | 3917 |
| CKAP5-427 | GUGUUGUAAGUAAGGUGUUCAAUCAAC | 3923 |
| CKAP5-600 | AAAGCCUUAAGUGAAUUUGGUUCCAAA | 3497 |
| CKAP5-604 | CCUUAAGUGAAUUUGGUUCCAAAAUCA | 3499 |
| CKAP5-686 | GGCUGUUCGAGAUGAAGCCAAACUAAU | 3929 |
| CKAP5-853 | CCCAACAAGAACUAGAAGCUAAAUUGG | 3507 |
| CKAP5-988 | AACUUCCCAAAGACUUUUAUGACAAAA | 3519 |
| CKAP5-992 | UCCCAAAGACUUUUAUGACAAAAUUGA | 3521 |
| CKAP5-1004 | UUAUGACAAAAUUGAGGCAAAAAAUG | 3527 |
| CKAP5-1046 | GGCCCUGGAGUCUGUAGAAGUACUAAU | 3937 |
| CKAP5-1162 | UGGCUUUGGCAGCAAAAUGUCUUACUG | 3537 |
| CKAP5-1168 | UGGCAGCAAAAUGUCUUACUGGCCUGG | 3540 |
| CKAP5-1294 | UGCAGGAGGCAAUUGAUGCAAUCUUCC | 3562 |
| CKAP5-1343 | CAGUGAGGAUGUUUUAGCAGUAAUGGA | 3944 |
| CKAP5-1358 | AGCAGUAAUGGAUAAUAAAAAUCCAAC | 3575 |
| CKAP5-1514 | AGUCAGAGAUGCCGCAUUUGAAGCAUU | 3948 |
| CKAP5-2096 | UGGAUGGAAAGAAACUAAUUUUCAGGU | 3596 |
| CKAP5-2098 | GAUGGAAAGAAACUAAUUUUCAGGUGA | 3597 |
| CKAP5-2214 | GACAAGAUUGGAGAUGUGAAAUGUGGG | 3611 |
| CKAP5-2220 | AUUGGAGAUGUGAAAUGUGGGAACAAU | 3614 |
| CKAP5-2230 | UGAAAUGUGGGAACAAUGCAAAAGAAG | 3619 |
| CKAP5-3328 | GGAAACUAAAGCCAACUUCUAAAGAUC | 3695 |
| CKAP5-4056 | AAGGAUGUCAUUCGUAAAGAUGUUCGU | 3720 |
| CKAP5-4241 | CCCAGGAAAAGCCUUAAAGGAAAUAGC | 3740 |
| CKAP5-4350 | CAGGUGUUCAAACUGAUUGGAAAUCUU | 3743 |
| CKAP5-4367 | UGGAAAUCUUUCUGAAAAGGAUAUGAG | 3992 |
| CKAP5-4756 | ACAGUAAUACAGCAUCCACAAUCAAUU | 3768 |
| CKAP5-5326 | AUAGCAUUAACCUAGACAGAAUUCUUC | 3815 |
| CKAP5-5396 | GAAGCAAUGCAAAAGUGAAUUUCCCAU | 3823 |
| CKAP5-5699 | ACUAGCAGAGUUAUAUGAAUAUAAGAA | 3860 |
| CKAP5-5703 | GCAGAGUUAUAUGAAUAUAAGAAGAAA | 3862 |
| CKAP5-5741 | UGACAUUGAACCAUUUCUGAAAAAUUC | 3868 |
| CKAP5-5944 | GGCCAUCUGUCUACUUGGAAAGGCUAA | 3879 |

More selections of 21 nucleotide CKAP5 mRNA targets included the following:

TABLE 18

CKAP5 21 Nucleotide mRNA Target Sequences of More Select dsRNAs

| Human CKAP5 Duplex Name | 21 Nucleotide Target Sequence | SEQ ID NO: |
|---|---|---|
| CKAP5-256 | UCCAGAAAAUAAAGGAUGAAA | 2319 |
| CKAP5-281 | CCCAGAGUGGUCCAAAUUUUU | 2765 |
| CKAP5-427 | GUGUUGUAAGUAAGGUGUUCA | 2771 |
| CKAP5-600 | AAAGCCUUAAGUGAAUUUGGU | 2345 |
| CKAP5-604 | CCUUAAGUGAAUUUGGUUCCA | 2347 |
| CKAP5-686 | GGCUGUUCGAGAUGAAGCCAA | 2777 |
| CKAP5-853 | CCCAACAAGAACUAGAAGCUA | 2355 |
| CKAP5-988 | AACUUCCCAAAGACUUUUAUG | 2367 |
| CKAP5-992 | UCCCAAAGACUUUUAUGACAA | 2369 |
| CKAP5-1004 | UUAUGACAAAAUUGAGGCAAA | 2375 |
| CKAP5-1046 | GGCCCUGGAGUCUGUAGAAGU | 2785 |
| CKAP5-1162 | UGGCUUUGGCAGCAAAAUGUC | 2385 |
| CKAP5-1168 | UGGCAGCAAAAUGUCUUACUG | 2388 |
| CKAP5-1294 | UGCAGGAGGCAAUUGAUGCAA | 2410 |
| CKAP5-1343 | CAGUGAGGAUGUUUUAGCAGU | 2792 |
| CKAP5-1358 | AGCAGUAAUGGAUAAUAAAAA | 2423 |
| CKAP5-1514 | AGUCAGAGAUGCCGCAUUUGA | 2796 |
| CKAP5-2096 | UGGAUGGAAAGAAACUAAUUU | 2444 |
| CKAP5-2098 | GAUGGAAAGAAACUAAUUUUC | 2445 |
| CKAP5-2214 | GACAAGAUUGGAGAUGUGAAA | 2459 |
| CKAP5-2220 | AUUGGAGAUGUGAAAUGUGGG | 2462 |
| CKAP5-2230 | UGAAAUGUGGGAACAAUGCAA | 2467 |
| CKAP5-3328 | GGAAACUAAAGCCAACUUCUA | 2543 |
| CKAP5-4056 | AAGGAUGUCAUUCGUAAAGAU | 2568 |
| CKAP5-4241 | CCCAGGAAAAGCCUUAAAGGA | 2588 |
| CKAP5-4350 | CAGGUGUUCAAACUGAUUGGA | 2591 |
| CKAP5-4367 | UGGAAAUCUUUCUGAAAAGGA | 2840 |
| CKAP5-4756 | ACAGUAAUACAGCAUCCACAA | 2616 |
| CKAP5-5326 | AUAGCAUUAACCUAGACAGAA | 2663 |
| CKAP5-5396 | GAAGCAAUGCAAAAGUGAAUU | 2671 |
| CKAP5-5699 | ACUAGCAGAGUUAUAUGAAUA | 2708 |
| CKAP5-5703 | GCAGAGUUAUAUGAAUAUAAG | 2710 |
| CKAP5-5741 | UGACAUUGAACCAUUUCUGAA | 2716 |
| CKAP5-5944 | GGCCAUCUGUCUACUUGGAAA | 2727 |

More selections of 19 nucleotide CKAP5 mRNA targets included the following:

TABLE 19

CKAP5 19 Nucleotide mRNA Target Sequences of More Selected dsRNAs

| Human CKAP5 Duplex Name | 19 Nucleotide Target Sequence | SEQ ID NO: |
|---|---|---|
| CKAP5-256 19nt Target #3 | UCCAGAAAAUAAAGGAUGA | 5199 |
| CKAP5-256 19nt Target #2 | CCAGAAAAUAAAGGAUGAA | 4623 |
| CKAP5-256 19nt Target #1 | CAGAAAAUAAAGGAUGAAA | 4047 |
| CKAP5-281 19nt Target #3 | CCCAGAGUGGUCCAAAUUU | 5645 |
| CKAP5-281 19nt Target #2 | CCAGAGUGGUCCAAAUUUU | 5069 |
| CKAP5-281 19nt Target #1 | CAGAGUGGUCCAAAUUUUU | 4493 |
| CKAP5-427 19nt Target #3 | GUGUUGUAAGUAAGGUGUU | 5651 |
| CKAP5-427 19nt Target #2 | UGUUGUAAGUAAGGUGUUC | 5075 |
| CKAP5-427 19nt Target #1 | GUUGUAAGUAAGGUGUUCA | 4499 |
| CKAP5-600 19nt Target #3 | AAAGCCUUAAGUGAAUUUG | 5225 |
| CKAP5-600 19nt Target #2 | AAGCCUUAAGUGAAUUUGG | 4649 |
| CKAP5-600 19nt Target #1 | AGCCUUAAGUGAAUUUGGU | 4073 |
| CKAP5-604 19nt Target #3 | CCUUAAGUGAAUUUGGUUC | 5227 |
| CKAP5-604 19nt Target #2 | CUUAAGUGAAUUUGGUUCC | 4651 |
| CKAP5-604 19nt Target #1 | UUAAGUGAAUUUGGUUCCA | 4075 |
| CKAP5-686 19nt Target #3 | GGCUGUUCGAGAUGAAGCC | 5657 |
| CKAP5-686 19nt Target #2 | GCUGUUCGAGAUGAAGCCA | 5081 |
| CKAP5-686 19nt Target #1 | CUGUUCGAGAUGAAGCCAA | 4505 |
| CKAP5-853 19nt Target #3 | CCCAACAAGAACUAGAAGC | 5235 |
| CKAP5-853 19nt Target #2 | CCAACAAGAACUAGAAGCU | 4659 |
| CKAP5-853 19nt Target #1 | CAACAAGAACUAGAAGCUA | 4083 |
| CKAP5-988 19nt Target #3 | AACUUCCCAAAGACUUUUA | 5247 |
| CKAP5-988 19nt Target #2 | ACUUCCCAAAGACUUUUAU | 4671 |
| CKAP5-988 19nt Target #1 | CUUCCCAAAGACUUUUAUG | 4095 |
| CKAP5-992 19nt Target #3 | UCCCAAAGACUUUUAUGAC | 5249 |
| CKAP5-992 19nt Target #2 | CCCAAAGACUUUUAUGACA | 4673 |
| CKAP5-992 19nt Target #1 | CCAAAGACUUUUAUGACAA | 4097 |
| CKAP5-1004 19nt Target #3 | UUAUGACAAAAUUGAGGCA | 5255 |
| CKAP5-1004 19nt Target #2 | UAUGACAAAAUUGAGGCAA | 4679 |
| CKAP5-1046 19nt Target #3 | GGCCCUGGAGUCUGUAGAA | 5665 |
| CKAP5-1046 19nt Target #2 | GCCCUGGAGUCUGUAGAAG | 5089 |
| CKAP5-1046 19nt Target #1 | CCCUGGAGUCUGUAGAAGU | 4513 |
| CKAP5-1162 19nt Target #3 | UGGCUUUGGCAGCAAAAUG | 5265 |
| CKAP5-1162 19nt Target #2 | GGCUUUGGCAGCAAAAUGU | 4689 |
| CKAP5-1162 19nt Target #1 | GCUUUGGCAGCAAAAUGUC | 4113 |
| CKAP5-1168 19nt Target #3 | UGGCAGCAAAAUGUCUUAC | 5268 |
| CKAP5-1168 19nt Target #2 | GGCAGCAAAAUGUCUUACU | 4692 |
| CKAP5-1168 19nt Target #1 | GCAGCAAAAUGUCUUACUG | 4116 |
| CKAP5-1294 19nt Target #3 | UGCAGGAGGCAAUUGAUGC | 5290 |
| CKAP5-1294 19nt Target #2 | GCAGGAGGCAAUUGAUGCA | 4714 |
| CKAP5-1294 19nt Target #1 | CAGGAGGCAAUUGAUGCAA | 4138 |
| CKAP5-1343 19nt Target #3 | CAGUGAGGAUGUUUUAGCA | 5672 |
| CKAP5-1343 19nt Target #2 | AGUGAGGAUGUUUUAGCAG | 5096 |
| CKAP5-1343 19nt Target #1 | GUGAGGAUGUUUUAGCAGU | 4520 |
| CKAP5-1358 19nt Target #3 | AGCAGUAAUGGAUAAUAAA | 5303 |
| CKAP5-1358 19nt Target #2 | GCAGUAAUGGAUAAUAAAA | 4727 |
| CKAP5-1358 19nt Target #1 | CAGUAAUGGAUAAUAAAAA | 4151 |
| CKAP5-1514 19nt Target #3 | AGUCAGAGAUGCCGCAUUU | 5676 |
| CKAP5-1514 19nt Target #2 | GUCAGAGAUGCCGCAUUUG | 5100 |
| CKAP5-1514 19nt Target #1 | UCAGAGAUGCCGCAUUUGA | 4524 |
| CKAP5-2096 19nt Target #3 | UGGAUGGAAAGAAACUAAU | 5324 |
| CKAP5-2096 19nt Target #2 | GGAUGGAAAGAAACUAAUU | 4748 |
| CKAP5-2096 19nt Target #1 | GAUGGAAAGAAACUAAUUU | 4172 |
| CKAP5-2098 19nt Target #3 | GAUGGAAAGAAACUAAUUU | 5325 |
| CKAP5-2098 19nt Target #2 | AUGGAAAGAAACUAAUUUU | 4749 |
| CKAP5-2098 19nt Target #1 | UGGAAAGAAACUAAUUUUC | 4173 |
| CKAP5-2214 19nt Target #3 | GACAAGAUUGGAGAUGUGA | 5339 |
| CKAP5-2214 19nt Target #2 | ACAAGAUUGGAGAUGUGAA | 4763 |
| CKAP5-2220 19nt Target #3 | AUUGGAGAUGUGAAAUGUG | 5342 |
| CKAP5-2220 19nt Target #2 | UUGGAGAUGUGAAAUGUGG | 4766 |
| CKAP5-2220 19nt Target #1 | UGGAGAUGUGAAAUGUGGG | 4190 |
| CKAP5-2230 19nt Target #3 | UGAAAUGUGGGAACAAUGC | 5347 |
| CKAP5-2230 19nt Target #2 | GAAAUGUGGGAACAAUGCA | 4771 |
| CKAP5-2230 19nt Target #1 | AAAUGUGGGAACAAUGCAA | 4195 |
| CKAP5-3287 19nt Target #2 | AUGAUGCAUUUAGGAUAUG | 4836 |
| CKAP5-3287 19nt Target #1 | UGAUGCAUUUAGGAUAUGA | 4260 |
| CKAP5-3328 19nt Target #3 | GGAAACUAAAGCCAACUUC | 5423 |
| CKAP5-3328 19nt Target #2 | GAAACUAAAGCCAACUUCU | 4847 |
| CKAP5-3328 19nt Target #1 | AAACUAAAGCCAACUUCUA | 4271 |
| CKAP5-4056 19nt Target #3 | AAGGAUGUCAUUCGUAAAG | 5448 |
| CKAP5-4056 19nt Target #1 | GGAUGUCAUUCGUAAAGAU | 4296 |
| CKAP5-4241 19nt Target #3 | CCCAGGAAAAGCCUUAAAG | 5468 |
| CKAP5-4241 19nt Target #2 | CCAGGAAAAGCCUUAAAGG | 4892 |

TABLE 19-continued

CKAP5 19 Nucleotide mRNA Target Sequences of
More Selected dsRNAs

| Human CKAP5 Duplex Name | 19 Nucleotide Target Sequence | SEQ ID NO: |
|---|---|---|
| CKAP5-4241 19nt Target #1 | CAGGAAAAGCCUUAAAGGA | 4316 |
| CKAP5-4350 19nt Target #3 | CAGGUGUUCAAACUGAUUG | 5471 |
| CKAP5-4350 19nt Target #2 | AGGUGUUCAAACUGAUUGG | 4895 |
| CKAP5-4350 19nt Target #1 | GGUGUUCAAACUGAUUGGA | 4319 |
| CKAP5-4367 19nt Target #3 | UGGAAAUCUUUCUGAAAAG | 5720 |
| CKAP5-4367 19nt Target #2 | GGAAAUCUUUCUGAAAAGG | 5144 |
| CKAP5-4367 19nt Target #1 | GAAAUCUUUCUGAAAAGGA | 4568 |
| CKAP5-4756 19nt Target #3 | ACAGUAAUACAGCAUCCAC | 5496 |
| CKAP5-4756 19nt Target #2 | CAGUAAUACAGCAUCCACA | 4920 |
| CKAP5-4756 19nt Target #1 | AGUAAUACAGCAUCCACAA | 4344 |
| CKAP5-5326 19nt Target #3 | AUAGCAUUAACCUAGACAG | 5163 |
| CKAP5-5326 19nt Target #2 | UAGCAUUAACCUAGACAGA | 4587 |
| CKAP5-5326 19nt Target #1 | AGCAUUAACCUAGACAGAA | 4011 |
| CKAP5-5396 19nt Target #3 | GAAGCAAUGCAAAAGUGAA | 5551 |
| CKAP5-5396 19nt Target #2 | AAGCAAUGCAAAAGUGAAU | 4975 |
| CKAP5-5396 19nt Target #1 | AGCAAUGCAAAAGUGAAUU | 4399 |
| CKAP5-5699 19nt Target #3 | ACUAGCAGAGUUAUAUGAA | 5588 |
| CKAP5-5699 19nt Target #2 | CUAGCAGAGUUAUAUGAAU | 5012 |
| CKAP5-5699 19nt Target #1 | UAGCAGAGUUAUAUGAAUA | 4436 |
| CKAP5-5703 19nt Target #3 | GCAGAGUUAUAUGAAUAUA | 5590 |
| CKAP5-5703 19nt Target #2 | CAGAGUUAUAUGAAUAUAA | 5014 |
| CKAP5-5703 19nt Target #1 | AGAGUUAUAUGAAUAUAAG | 4438 |
| CKAP5-5741 19nt Target #3 | UGACAUUGAACCAUUUCUG | 5596 |
| CKAP5-5741 19nt Target #2 | GACAUUGAACCAUUUCUGA | 5020 |
| CKAP5-5741 19nt Target #1 | ACAUUGAACCAUUUCUGAA | 4444 |
| CKAP5-5944 19nt Target #3 | GGCCAUCUGUCUACUUGGA | 5607 |
| CKAP5-5944 19nt Target #2 | GCCAUCUGUCUACUUGGAA | 5031 |
| CKAP5-5944 19nt Target #1 | CCAUCUGUCUACUUGGAAA | 4455 |

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying DsiRNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

The use of the terms "a" and "an" and "the" and similar referents in the context of describing the invention (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted. Recitation of ranges of values herein are merely intended to serve as a shorthand method of referring individually to each separate value falling within the range, unless otherwise indicated herein, and each separate value is incorporated into the specification as if it were individually recited herein. All methods described herein can be performed in any suitable order unless otherwise indicated herein or otherwise clearly contradicted by context. The use of any and all examples, or exemplary language (e.g., "such as") provided herein, is intended merely to better illuminate the invention and does not pose a limitation on the scope of the invention unless otherwise claimed. No language in the specification should be construed as indicating any non-claimed element as essential to the practice of the invention.

Embodiments of this invention are described herein, including the best mode known to the inventors for carrying out the invention. Variations of those embodiments may become apparent to those of ordinary skill in the art upon reading the foregoing description.

The inventors expect skilled artisans to employ such variations as appropriate, and the inventors intend for the invention to be practiced otherwise than as specifically described herein. Accordingly, this invention includes all modifications and equivalents of the subject matter recited in the claims appended hereto as permitted by applicable law. Moreover, any combination of the above-described elements in all possible variations thereof is encompassed by the invention unless otherwise indicated herein or otherwise clearly contradicted by context. Those skilled in the art will recognize, or be able to ascertain using no more than routine experimentation, many equivalents to the specific embodiments of the invention described herein. Such equivalents are intended to be encompassed by the following claims.

SEQUENCE LISTING (5850 sequences)

SEQ ID NO: 1 - DNA, 25 bp, Artificial Sequence
  Synthetic Oligonucleotide
gaagcacaaugggagaugacaguga

SEQ ID NO: 2 - DNA, 25 bp, Artificial Sequence
  Synthetic Oligonucleotide
agcacaaugggagaugacagugagt

SEQ ID NO: 3 - DNA, 25 bp, Artificial Sequence
  Synthetic Oligonucleotide
cacaaugggagaugacagugagugg

SEQ ID NO: 4 - DNA, 25 bp, Artificial Sequence
  Synthetic Oligonucleotide
caaugggagaugacagugaguggtt

SEQ ID NO: 5 - DNA, 25 bp, Artificial Sequence
  Synthetic Oligonucleotide
augggagaugacagugagugguuga

SEQ ID NO: 6 - DNA, 25 bp, Artificial Sequence
  Synthetic Oligonucleotide
gggagaugacagugagugguugaaa

SEQ ID NO: 7 - DNA, 25 bp, Artificial Sequence
  Synthetic Oligonucleotide
gagaugacagugagugguugaaact

SEQ ID NO: 8 - DNA, 25 bp, Artificial Sequence
  Synthetic Oligonucleotide
gaugacagugagugguugaaacugc

SEQ ID NO: 9 - DNA, 25 bp, Artificial Sequence
  Synthetic Oligonucleotide
ugacagugagugguugaaacugcca

SEQ ID NO: 10 - DNA, 25 bp, Artificial Sequence
  Synthetic Oligonucleotide
gaagaucuuccagaaaauaaaggat

SEQ ID NO: 11 - DNA, 25 bp, Artificial Sequence
  Synthetic Oligonucleotide
agaucuuccagaaaauaaaggauga

SEQ ID NO: 12 - DNA, 25 bp, Artificial Sequence
  Synthetic Oligonucleotide
aucuuccagaaaauaaaggaugaaa

SEQ ID NO: 13 - DNA, 25 bp, Artificial Sequence
  Synthetic Oligonucleotide
cuuccagaaaauaaaggaugaaaag

SEQ ID NO: 14 - DNA, 25 bp, Artificial Sequence
  Synthetic Oligonucleotide
uccagaaaauaaaggaugaaaagag

SEQ ID NO: 15 - DNA, 25 bp, Artificial Sequence
  Synthetic Oligonucleotide
cagaaaauaaaggaugaaaagagcc

SEQ ID NO: 16 - DNA, 25 bp, Artificial Sequence
  Synthetic Oligonucleotide
gaaaauaaaggaugaaaagagccca

SEQ ID NO: 17 - DNA, 25 bp, Artificial Sequence
  Synthetic Oligonucleotide
aaauaaaggaugaaaagagcccaga

SEQ ID NO: 18 - DNA, 25 bp, Artificial Sequence
  Synthetic Oligonucleotide
ucaaaaaauuugucacugauuccaa

SEQ ID NO: 19 - DNA, 25 bp, Artificial Sequence
  Synthetic Oligonucleotide
aaaaaauuugucacugauuccaatg

SEQ ID NO: 20 - DNA, 25 bp, Artificial Sequence
  Synthetic Oligonucleotide
aaaauuugucacugauuccaaugca

SEQ ID NO: 21 - DNA, 25 bp, Artificial Sequence
  Synthetic Oligonucleotide
aauuugucacugauuccaaugcagt

SEQ ID NO: 22 - DNA, 25 bp, Artificial Sequence
  Synthetic Oligonucleotide
uuugucacugauuccaaugcagugg

SEQ ID NO: 23 - DNA, 25 bp, Artificial Sequence
  Synthetic Oligonucleotide
ugucacugauuccaaugcaguggtt

SEQ ID NO: 24 - DNA, 25 bp, Artificial Sequence
  Synthetic Oligonucleotide
ucacugauuccaaugcagugguuca

SEQ ID NO: 25 - DNA, 25 bp, Artificial Sequence
  Synthetic Oligonucleotide
acugauuccaaugcagugguucaat

SEQ ID NO: 26 - DNA, 25 bp, Artificial Sequence
  Synthetic Oligonucleotide
ugauuccaaugcagugguucaautg

SEQ ID NO: 27 - DNA, 25 bp, Artificial Sequence
  Synthetic Oligonucleotide
auuccaaugcagugguucaauugaa

SEQ ID NO: 28 - DNA, 25 bp, Artificial Sequence
  Synthetic Oligonucleotide
uccaaugcagugguucaauugaaag

SEQ ID NO: 29 - DNA, 25 bp, Artificial Sequence
  Synthetic Oligonucleotide
caaugcagugguucaauugaaagga

SEQ ID NO: 30 - DNA, 25 bp, Artificial Sequence
  Synthetic Oligonucleotide
augcagugguucaauugaaaggatt

SEQ ID NO: 31 - DNA, 25 bp, Artificial Sequence
  Synthetic Oligonucleotide
gcagugguucaauugaaaggauuag

SEQ ID NO: 32 - DNA, 25 bp, Artificial Sequence
  Synthetic Oligonucleotide
agugguucaauugaaaggauuagaa

SEQ ID NO: 33 - DNA, 25 bp, Artificial Sequence
  Synthetic Oligonucleotide
aagaucauaguggccuguauagaga

SEQ ID NO: 34 - DNA, 25 bp, Artificial Sequence
  Synthetic Oligonucleotide
gaucauaguggccuguauagagaca

SEQ ID NO: 35 - DNA, 25 bp, Artificial Sequence
  Synthetic Oligonucleotide
ucauaguggccuguauagagacact

SEQ ID NO: 36 - DNA, 25 bp, Artificial Sequence
  Synthetic Oligonucleotide
cacugaggaaagccuuaagugaatt

SEQ ID NO: 37 - DNA, 25 bp, Artificial Sequence
  Synthetic Oligonucleotide
cugaggaaagccuuaagugaauutg

SEQ ID NO: 38 - DNA, 25 bp, Artificial Sequence
  Synthetic Oligonucleotide
gaggaaagccuuaagugaauuuggt

SEQ ID NO: 39 - DNA, 25 bp, Artificial Sequence
  Synthetic Oligonucleotide
ggaaagccuuaagugaauuuggutc

SEQ ID NO: 40 - DNA, 25 bp, Artificial Sequence
  Synthetic Oligonucleotide
aaagccuuaagugaauuugguucca

SEQ ID NO: 41 - DNA, 25 bp, Artificial Sequence
  Synthetic Oligonucleotide
agccuuaagugaauuugguuccaaa

SEQ ID NO: 42 - DNA, 25 bp, Artificial Sequence
  Synthetic Oligonucleotide
ccuuaagugaauuugguuccaaaat

SEQ ID NO: 43 - DNA, 25 bp, Artificial Sequence
  Synthetic Oligonucleotide
uuaagugaauuugguuccaaaauca

SEQ ID NO: 44 - DNA, 25 bp, Artificial Sequence
  Synthetic Oligonucleotide
aagugaauuugguuccaaaaucatc

SEQ ID NO: 45 - DNA, 25 bp, Artificial Sequence
  Synthetic Oligonucleotide
gugaauuugguuccaaaaucauctt

SEQ ID NO: 46 - DNA, 25 bp, Artificial Sequence
  Synthetic Oligonucleotide
gaauuugguuccaaaaucaucuugc

SEQ ID NO: 47 - DNA, 25 bp, Artificial Sequence
  Synthetic Oligonucleotide
auuugguuccaaaaucaucuugctt

SEQ ID NO: 48 - DNA, 25 bp, Artificial Sequence
  Synthetic Oligonucleotide
cguucccaacaagaacuagaagcta

SEQ ID NO: 49 - DNA, 25 bp, Artificial Sequence
  Synthetic Oligonucleotide
uucccaacaagaacuagaagcuaaa

SEQ ID NO: 50 - DNA, 25 bp, Artificial Sequence
  Synthetic Oligonucleotide
cccaacaagaacuagaagcuaaatt

SEQ ID NO: 51 - DNA, 25 bp, Artificial Sequence
  Synthetic Oligonucleotide
caacaagaacuagaagcuaaauugg

SEQ ID NO: 52 - DNA, 25 bp, Artificial Sequence
  Synthetic Oligonucleotide
acaagaacuagaagcuaaauuggaa

SEQ ID NO: 53 - DNA, 25 bp, Artificial Sequence
  Synthetic Oligonucleotide
aacagucugcugguggagaugcuga

SEQ ID NO: 54 - DNA, 25 bp, Artificial Sequence
  Synthetic Oligonucleotide
cagucugcugguggagaugcugaag

SEQ ID NO: 55 - DNA, 25 bp, Artificial Sequence
  Synthetic Oligonucleotide
guggugaugauggugaugaggugcc

SEQ ID NO: 56 - DNA, 25 bp, Artificial Sequence
  Synthetic Oligonucleotide
ggugaugauggugaugaggugccac

SEQ ID NO: 57 - DNA, 25 bp, Artificial Sequence
  Synthetic Oligonucleotide
auccuuuccaaacuucccaaagact

SEQ ID NO: 58 - DNA, 25 bp, Artificial Sequence
  Synthetic Oligonucleotide
ccuuuccaaacuucccaaagacutt

SEQ ID NO: 59 - DNA, 25 bp, Artificial Sequence
  Synthetic Oligonucleotide
uuuccaaacuucccaaagacuuuta

SEQ ID NO: 60 - DNA, 25 bp, Artificial Sequence
  Synthetic Oligonucleotide
uccaaacuucccaaagacuuuuatg

SEQ ID NO: 61 - DNA, 25 bp, Artificial Sequence
  Synthetic Oligonucleotide
caaacuucccaaagacuuuuaugac

SEQ ID NO: 62 - DNA, 25 bp, Artificial Sequence
  Synthetic Oligonucleotide
aacuucccaaagacuuuuaugacaa

SEQ ID NO: 63 - DNA, 25 bp, Artificial Sequence
  Synthetic Oligonucleotide
cuucccaaagacuuuuaugacaaaa

SEQ ID NO: 64 - DNA, 25 bp, Artificial Sequence
  Synthetic Oligonucleotide
ucccaaagacuuuuaugacaaaatt

SEQ ID NO: 65 - DNA, 25 bp, Artificial Sequence
  Synthetic Oligonucleotide
ccaaagacuuuuaugacaaaauuga

SEQ ID NO: 66 - DNA, 25 bp, Artificial Sequence
  Synthetic Oligonucleotide
aaagacuuuuaugacaaaauugagg

SEQ ID NO: 67 - DNA, 25 bp, Artificial Sequence
  Synthetic Oligonucleotide
agacuuuuaugacaaaauugaggca

SEQ ID NO: 68 - DNA, 25 bp, Artificial Sequence
  Synthetic Oligonucleotide
acuuuuaugacaaaauugaggcaaa

SEQ ID NO: 69 - DNA, 25 bp, Artificial Sequence
  Synthetic Oligonucleotide
uuuuaugacaaaauugaggcaaaaa

SEQ ID NO: 70 - DNA, 25 bp, Artificial Sequence
  Synthetic Oligonucleotide
uuaugacaaaauugaggcaaaaaaa

SEQ ID NO: 71 - DNA, 25 bp, Artificial Sequence
  Synthetic Oligonucleotide
augacaaaauugaggcaaaaaaatg

SEQ ID NO: 72 - DNA, 25 bp, Artificial Sequence
  Synthetic Oligonucleotide
aauggcaagagagaaaagaggccct

SEQ ID NO: 73 - DNA, 25 bp, Artificial Sequence
  Synthetic Oligonucleotide
agguuguuggaaaggacaccaaugt

SEQ ID NO: 74 - DNA, 25 bp, Artificial Sequence
  Synthetic Oligonucleotide
guuguuggaaaggacaccaauguca

SEQ ID NO: 75 - DNA, 25 bp, Artificial Sequence
  Synthetic Oligonucleotide
uguuggaaaggacaccaaugucatg

SEQ ID NO: 76 - DNA, 25 bp, Artificial Sequence
  Synthetic Oligonucleotide
uuggaaaggacaccaaugucaugtt

SEQ ID NO: 77 - DNA, 25 bp, Artificial Sequence
  Synthetic Oligonucleotide
ggaaaggacaccaaugucauguugg

SEQ ID NO: 78 - DNA, 25 bp, Artificial Sequence
  Synthetic Oligonucleotide
aaaggacaccaaugucauguuggtg

SEQ ID NO: 79 - DNA, 25 bp, Artificial Sequence
  Synthetic Oligonucleotide
aggacaccaaugucauguugguggc

SEQ ID NO: 80 - DNA, 25 bp, Artificial Sequence
  Synthetic Oligonucleotide
gacaccaaugucauguugguggctt

SEQ ID NO: 81 - DNA, 25 bp, Artificial Sequence
  Synthetic Oligonucleotide
gcuuuggcagcaaaaugucuuactg

SEQ ID NO: 82 - DNA, 25 bp, Artificial Sequence
  Synthetic Oligonucleotide
uuuggcagcaaaaugucuuacuggc

SEQ ID NO: 83 - DNA, 25 bp, Artificial Sequence
  Synthetic Oligonucleotide
uggcagcaaaaugucuuacuggcct

SEQ ID NO: 84 - DNA, 25 bp, Artificial Sequence
  Synthetic Oligonucleotide
gcagcaaaaugucuuacuggccugg

SEQ ID NO: 85 - DNA, 25 bp, Artificial Sequence
  Synthetic Oligonucleotide
agcaaaaugucuuacuggccuggct

SEQ ID NO: 86 - DNA, 25 bp, Artificial Sequence
  Synthetic Oligonucleotide
agaaauuuggacaauaugcaggaca

SEQ ID NO: 87 - DNA, 25 bp, Artificial Sequence
  Synthetic Oligonucleotide
aaauuuggacaauaugcaggacatg

SEQ ID NO: 88 - DNA, 25 bp, Artificial Sequence
  Synthetic Oligonucleotide
auuuggacaauaugcaggacaugtt

SEQ ID NO: 89 - DNA, 25 bp, Artificial Sequence
  Synthetic Oligonucleotide
uuggacaauaugcaggacauguugt

SEQ ID NO: 90 - DNA, 25 bp, Artificial Sequence
  Synthetic Oligonucleotide
ggacaauaugcaggacauguugugc

SEQ ID NO: 91 - DNA, 25 bp, Artificial Sequence
  Synthetic Oligonucleotide
acaauaugcaggacauguugugcca

SEQ ID NO: 92 - DNA, 25 bp, Artificial Sequence
  Synthetic Oligonucleotide
aauaugcaggacauguugugccaac

SEQ ID NO: 93 - DNA, 25 bp, Artificial Sequence
  Synthetic Oligonucleotide
uaugcaggacauguugugccaacca

SEQ ID NO: 94 - DNA, 25 bp, Artificial Sequence
  Synthetic Oligonucleotide
ugcaggacauguugugccaaccatc

SEQ ID NO: 95 - DNA, 25 bp, Artificial Sequence
  Synthetic Oligonucleotide
caggacauguugugccaaccauctt

SEQ ID NO: 96 - DNA, 25 bp, Artificial Sequence
  Synthetic Oligonucleotide
cucaagugguacaagcccugcagga

SEQ ID NO: 97 - DNA, 25 bp, Artificial Sequence
  Synthetic Oligonucleotide
caagugguacaagcccugcaggagg

SEQ ID NO: 98 - DNA, 25 bp, Artificial Sequence
  Synthetic Oligonucleotide
agugguacaagcccugcaggaggca

SEQ ID NO: 99 - DNA, 25 bp, Artificial Sequence
  Synthetic Oligonucleotide
ugguacaagcccugcaggaggcaat

SEQ ID NO: 100 - DNA, 25 bp, Artificial Sequence
  Synthetic Oligonucleotide
guacaagcccugcaggaggcaautg

SEQ ID NO: 101 - DNA, 25 bp, Artificial Sequence
  Synthetic Oligonucleotide
acaagcccugcaggaggcaauugat

SEQ ID NO: 102 - DNA, 25 bp, Artificial Sequence
  Synthetic Oligonucleotide
aagcccugcaggaggcaauugaugc

SEQ ID NO: 103 - DNA, 25 bp, Artificial Sequence
  Synthetic Oligonucleotide
gcccugcaggaggcaauugaugcaa

SEQ ID NO: 104 - DNA, 25 bp, Artificial Sequence
  Synthetic Oligonucleotide
ccugcaggaggcaauugaugcaatc

SEQ ID NO: 105 - DNA, 25 bp, Artificial Sequence
  Synthetic Oligonucleotide
ugcaggaggcaauugaugcaauctt

SEQ ID NO: 106 - DNA, 25 bp, Artificial Sequence
  Synthetic Oligonucleotide
caggaggcaauugaugcaaucuucc

SEQ ID NO: 107 - DNA, 25 bp, Artificial Sequence
  Synthetic Oligonucleotide
ggaggcaauugaugcaaucuucctt

SEQ ID NO: 108 - DNA, 25 bp, Artificial Sequence
  Synthetic Oligonucleotide
aggcaauugaugcaaucuuccuuac

SEQ ID NO: 109 - DNA, 25 bp, Artificial Sequence
  Synthetic Oligonucleotide
gcaauugaugcaaucuuccuuacta

SEQ ID NO: 110 - DNA, 25 bp, Artificial Sequence
  Synthetic Oligonucleotide
acuaccacacuacagaacaucagtg

SEQ ID NO: 111 - DNA, 25 bp, Artificial Sequence
  Synthetic Oligonucleotide
uaccacacuacagaacaucagugag

SEQ ID NO: 112 - DNA, 25 bp, Artificial Sequence
  Synthetic Oligonucleotide
ccacacuacagaacaucagugagga

SEQ ID NO: 113 - DNA, 25 bp, Artificial Sequence
  Synthetic Oligonucleotide
acacuacagaacaucagugaggatg

SEQ ID NO: 114 - DNA, 25 bp, Artificial Sequence
  Synthetic Oligonucleotide
acuacagaacaucagugaggaugtt

SEQ ID NO: 115 - DNA, 25 bp, Artificial Sequence
  Synthetic Oligonucleotide
uacagaacaucagugaggauguutt

SEQ ID NO: 116 - DNA, 25 bp, Artificial Sequence
  Synthetic Oligonucleotide
cagaacaucagugaggauguuuuag

SEQ ID NO: 117 - DNA, 25 bp, Artificial Sequence
  Synthetic Oligonucleotide
uuagcaguaauggauaauaaaaatc

SEQ ID NO: 118 - DNA, 25 bp, Artificial Sequence
  Synthetic Oligonucleotide
agcaguaauggauaauaaaaaucca

SEQ ID NO: 119 - DNA, 25 bp, Artificial Sequence
  Synthetic Oligonucleotide
caguaauggauaauaaaaauccaac

SEQ ID NO: 120 - DNA, 25 bp, Artificial Sequence
  Synthetic Oligonucleotide
guaauggauaauaaaaauccaacca

SEQ ID NO: 121 - DNA, 25 bp, Artificial Sequence
  Synthetic Oligonucleotide
accaucaagcagcagacaucucutt

SEQ ID NO: 122 - DNA, 25 bp, Artificial Sequence
  Synthetic Oligonucleotide
cuacuuaagcacaucaaugauuctg

SEQ ID NO: 123 - DNA, 25 bp, Artificial Sequence
  Synthetic Oligonucleotide
acuuaagcacaucaaugauucugct

SEQ ID NO: 124 - DNA, 25 bp, Artificial Sequence
  Synthetic Oligonucleotide
uuaagcacaucaaugauucugcucc

SEQ ID NO: 125 - DNA, 25 bp, Artificial Sequence
  Synthetic Oligonucleotide
aagcacaucaaugauucugcucctg

SEQ ID NO: 126 - DNA, 25 bp, Artificial Sequence
  Synthetic Oligonucleotide
gcacaucaaugauucugcuccugaa

SEQ ID NO: 127 - DNA, 25 bp, Artificial Sequence
  Synthetic Oligonucleotide
acaucaaugauucugcuccugaagt

SEQ ID NO: 128 - DNA, 25 bp, Artificial Sequence
  Synthetic Oligonucleotide
aucaaugauucugcuccugaaguca

SEQ ID NO: 129 - DNA, 25 bp, Artificial Sequence
  Synthetic Oligonucleotide
caaugauucugcuccugaagucaga

SEQ ID NO: 130 - DNA, 25 bp, Artificial Sequence
  Synthetic Oligonucleotide
augauucugcuccugaagucagaga

SEQ ID NO: 131 - DNA, 25 bp, Artificial Sequence
  Synthetic Oligonucleotide
gauucugcuccugaagucagagatg

SEQ ID NO: 132 - DNA, 25 bp, Artificial Sequence
  Synthetic Oligonucleotide
uucugcuccugaagucagagaugcc

SEQ ID NO: 133 - DNA, 25 bp, Artificial Sequence
  Synthetic Oligonucleotide
cugcuccugaagucagagaugccgc

SEQ ID NO: 134 - DNA, 25 bp, Artificial Sequence
  Synthetic Oligonucleotide
gcuccugaagucagagaugccgcat

SEQ ID NO: 135 - DNA, 25 bp, Artificial Sequence
  Synthetic Oligonucleotide
gaucaaagaauguucagaaaaggta

SEQ ID NO: 136 - DNA, 25 bp, Artificial Sequence
  Synthetic Oligonucleotide
ucaaagaauguucagaaaagguaga

SEQ ID NO: 137 - DNA, 25 bp, Artificial Sequence
  Synthetic Oligonucleotide
aaccuggauggaaagaaacuaautt

SEQ ID NO: 138 - DNA, 25 bp, Artificial Sequence
  Synthetic Oligonucleotide
ccuggauggaaagaaacuaauuutc

SEQ ID NO: 139 - DNA, 25 bp, Artificial Sequence
  Synthetic Oligonucleotide
uggauggaaagaaacuaauuuucag

SEQ ID NO: 140 - DNA, 25 bp, Artificial Sequence
  Synthetic Oligonucleotide
gauggaaagaaacuaauuuucaggt

SEQ ID NO: 141 - DNA, 25 bp, Artificial Sequence
  Synthetic Oligonucleotide
uggaaagaaacuaauuuucagguga

SEQ ID NO: 142 - DNA, 25 bp, Artificial Sequence
  Synthetic Oligonucleotide
gaaagaaacuaauuuucaggugatg

SEQ ID NO: 143 - DNA, 25 bp, Artificial Sequence
  Synthetic Oligonucleotide
aagaaacuaauuuucaggugaugca

SEQ ID NO: 144 - DNA, 25 bp, Artificial Sequence
  Synthetic Oligonucleotide
gaaacuaauuuucaggugaugcaaa

SEQ ID NO: 145 - DNA, 25 bp, Artificial Sequence
  Synthetic Oligonucleotide
aacuaauuuucaggugaugcaaatg

SEQ ID NO: 146 - DNA, 25 bp, Artificial Sequence
  Synthetic Oligonucleotide
cuaauuuucaggugaugcaaaugaa

SEQ ID NO: 147 - DNA, 25 bp, Artificial Sequence
  Synthetic Oligonucleotide
uugcuuugauugcccagaagggaaa

SEQ ID NO: 148 - DNA, 25 bp, Artificial Sequence
  Synthetic Oligonucleotide
gcuuugauugcccagaagggaaatt

SEQ ID NO: 149 - DNA, 25 bp, Artificial Sequence
  Synthetic Oligonucleotide
uuugauugcccagaagggaaauutt

SEQ ID NO: 150 - DNA, 25 bp, Artificial Sequence
  Synthetic Oligonucleotide
ugauugcccagaagggaaauuuutc

SEQ ID NO: 151 - DNA, 25 bp, Artificial Sequence
  Synthetic Oligonucleotide
auugcccagaagggaaauuuuucca

SEQ ID NO: 152 - DNA, 25 bp, Artificial Sequence
  Synthetic Oligonucleotide
ugcccagaagggaaauuuuuccaaa

SEQ ID NO: 153 - DNA, 25 bp, Artificial Sequence
  Synthetic Oligonucleotide
cccagaagggaaauuuuuccaaaac

SEQ ID NO: 154 - DNA, 25 bp, Artificial Sequence
  Synthetic Oligonucleotide
gacaagauuggagaugugaaaugtg

SEQ ID NO: 155 - DNA, 25 bp, Artificial Sequence
  Synthetic Oligonucleotide
caagauuggagaugugaaauguggg

SEQ ID NO: 156 - DNA, 25 bp, Artificial Sequence
  Synthetic Oligonucleotide
agauuggagaugugaaaugugggaa

SEQ ID NO: 157 - DNA, 25 bp, Artificial Sequence
  Synthetic Oligonucleotide
auuggagaugugaaaugugggaaca

SEQ ID NO: 158 - DNA, 25 bp, Artificial Sequence
  Synthetic Oligonucleotide
uggagaugugaaaugugggaacaat

SEQ ID NO: 159 - DNA, 25 bp, Artificial Sequence
  Synthetic Oligonucleotide
gagaugugaaaugugggaacaaugc

SEQ ID NO: 160 - DNA, 25 bp, Artificial Sequence
  Synthetic Oligonucleotide
gaugugaaaugugggaacaaugcaa

SEQ ID NO: 161 - DNA, 25 bp, Artificial Sequence
  Synthetic Oligonucleotide
ugugaaaugugggaacaaugcaaaa

SEQ ID NO: 162 - DNA, 25 bp, Artificial Sequence
  Synthetic Oligonucleotide
ugaaaugugggaacaaugcaaaaga

SEQ ID NO: 163 - DNA, 25 bp, Artificial Sequence
  Synthetic Oligonucleotide
aaaugugggaacaaugcaaaagaag

SEQ ID NO: 164 - DNA, 25 bp, Artificial Sequence
  Synthetic Oligonucleotide
augugggaacaaugcaaaagaagct

SEQ ID NO: 165 - DNA, 25 bp, Artificial Sequence
  Synthetic Oligonucleotide
gugggaacaaugcaaaagaagcuat

SEQ ID NO: 166 - DNA, 25 bp, Artificial Sequence
  Synthetic Oligonucleotide
gggaacaaugcaaaagaagcuauga

SEQ ID NO: 167 - DNA, 25 bp, Artificial Sequence
  Synthetic Oligonucleotide
guugaaugucaaagcuuucauuagc

SEQ ID NO: 168 - DNA, 25 bp, Artificial Sequence
  Synthetic Oligonucleotide
ugaaugucaaagcuuucauuagcaa

SEQ ID NO: 169 - DNA, 25 bp, Artificial Sequence
  Synthetic Oligonucleotide
aaugucaaagcuuucauuagcaatg

SEQ ID NO: 170 - DNA, 25 bp, Artificial Sequence
  Synthetic Oligonucleotide
ugucaaagcuuucauuagcaaugtg

SEQ ID NO: 171 - DNA, 25 bp, Artificial Sequence
  Synthetic Oligonucleotide
ucaaagcuuucauuagcaaugugaa

SEQ ID NO: 172 - DNA, 25 bp, Artificial Sequence
  Synthetic Oligonucleotide
cccugcuuggcgugauguaucugta

SEQ ID NO: 173 - DNA, 25 bp, Artificial Sequence
  Synthetic Oligonucleotide
cugcuuggcgugauguaucuguatg

SEQ ID NO: 174 - DNA, 25 bp, Artificial Sequence
  Synthetic Oligonucleotide
ucuuugaggaugagaagccugccct

SEQ ID NO: 175 - DNA, 25 bp, Artificial Sequence
  Synthetic Oligonucleotide
uuugaggaugagaagccugcccucc

SEQ ID NO: 176 - DNA, 25 bp, Artificial Sequence
  Synthetic Oligonucleotide
ugaggaugagaagccugcccuccta

SEQ ID NO: 177 - DNA, 25 bp, Artificial Sequence
  Synthetic Oligonucleotide
aggaugagaagccugcccuccuatc

SEQ ID NO: 178 - DNA, 25 bp, Artificial Sequence
  Synthetic Oligonucleotide
gaugagaagccugcccuccuauccc

SEQ ID NO: 179 - DNA, 25 bp, Artificial Sequence
  Synthetic Oligonucleotide
ugagaagccugcccuccuaucccag

SEQ ID NO: 180 - DNA, 25 bp, Artificial Sequence
  Synthetic Oligonucleotide
agaagccugcccuccuaucccagat

SEQ ID NO: 181 - DNA, 25 bp, Artificial Sequence
  Synthetic Oligonucleotide
aagccugcccuccuaucccagauag

SEQ ID NO: 182 - DNA, 25 bp, Artificial Sequence
  Synthetic Oligonucleotide
gccugcccuccuaucccagauagat

SEQ ID NO: 183 - DNA, 25 bp, Artificial Sequence
  Synthetic Oligonucleotide
cugcccuccuaucccagauagaugc

SEQ ID NO: 184 - DNA, 25 bp, Artificial Sequence
  Synthetic Oligonucleotide
gcccuccuaucccagauagaugcag

SEQ ID NO: 185 - DNA, 25 bp, Artificial Sequence
  Synthetic Oligonucleotide
ccuccuaucccagauagaugcagaa

SEQ ID NO: 186 - DNA, 25 bp, Artificial Sequence
  Synthetic Oligonucleotide
uccuaucccagauagaugcagaatt

SEQ ID NO: 187 - DNA, 25 bp, Artificial Sequence
  Synthetic Oligonucleotide
cuaucccagauagaugcagaauutg

SEQ ID NO: 188 - DNA, 25 bp, Artificial Sequence
  Synthetic Oligonucleotide
aucccagauagaugcagaauuugag

SEQ ID NO: 189 - DNA, 25 bp, Artificial Sequence
  Synthetic Oligonucleotide
cccagauagaugcagaauuugagaa

SEQ ID NO: 190 - DNA, 25 bp, Artificial Sequence
  Synthetic Oligonucleotide
aagaugcagggacaaaguccacctg

SEQ ID NO: 191 - DNA, 25 bp, Artificial Sequence
  Synthetic Oligonucleotide
uacagaugaaggagaagauggagat

SEQ ID NO: 192 - DNA, 25 bp, Artificial Sequence
  Synthetic Oligonucleotide
cagaugaaggagaagauggagauga

SEQ ID NO: 193 - DNA, 25 bp, Artificial Sequence
  Synthetic Oligonucleotide
gaugaaggagaagauggagaugaac

SEQ ID NO: 194 - DNA, 25 bp, Artificial Sequence
  Synthetic Oligonucleotide
guugaucuuuugccgaggacggaga

SEQ ID NO: 195 - DNA, 25 bp, Artificial Sequence
  Synthetic Oligonucleotide
ggaaagaaggccuagaugaaguggc

SEQ ID NO: 196 - DNA, 25 bp, Artificial Sequence
  Synthetic Oligonucleotide
aaagaaggccuagaugaaguggcag

SEQ ID NO: 197 - DNA, 25 bp, Artificial Sequence
  Synthetic Oligonucleotide
agaaggccuagaugaaguggcaggt

SEQ ID NO: 198 - DNA, 25 bp, Artificial Sequence
  Synthetic Oligonucleotide
aaggccuagaugaaguggcagguat

SEQ ID NO: 199 - DNA, 25 bp, Artificial Sequence
  Synthetic Oligonucleotide
ggccuagaugaaguggcagguauta

SEQ ID NO: 200 - DNA, 25 bp, Artificial Sequence
  Synthetic Oligonucleotide
ccuagaugaaguggcagguauuatt

SEQ ID NO: 201 - DNA, 25 bp, Artificial Sequence
  Synthetic Oligonucleotide
uagaugaaguggcagguauuauuaa

SEQ ID NO: 202 - DNA, 25 bp, Artificial Sequence
  Synthetic Oligonucleotide
gaugaaguggcagguauuauuaatg

SEQ ID NO: 203 - DNA, 25 bp, Artificial Sequence
  Synthetic Oligonucleotide
aauauaggugaacuuccaacugcct

SEQ ID NO: 204 - DNA, 25 bp, Artificial Sequence
  Synthetic Oligonucleotide
uauaggugaacuuccaacugccutg

SEQ ID NO: 205 - DNA, 25 bp, Artificial Sequence
  Synthetic Oligonucleotide
uaggugaacuuccaacugccuugaa

SEQ ID NO: 206 - DNA, 25 bp, Artificial Sequence
  Synthetic Oligonucleotide
ggugaacuuccaacugccuugaagg

SEQ ID NO: 207 - DNA, 25 bp, Artificial Sequence
  Synthetic Oligonucleotide
ugaacuuccaacugccuugaagggt

SEQ ID NO: 208 - DNA, 25 bp, Artificial Sequence
  Synthetic Oligonucleotide
aacuuccaacugccuugaagggucg

SEQ ID NO: 209 - DNA, 25 bp, Artificial Sequence
  Synthetic Oligonucleotide
cuuccaacugccuugaagggucgac

SEQ ID NO: 210 - DNA, 25 bp, Artificial Sequence
  Synthetic Oligonucleotide
uccaacugccuugaagggucgactc

SEQ ID NO: 211 - DNA, 25 bp, Artificial Sequence
  Synthetic Oligonucleotide
caacugccuugaagggucgacucaa

SEQ ID NO: 212 - DNA, 25 bp, Artificial Sequence
  Synthetic Oligonucleotide
acugccuugaagggucgacucaatg

SEQ ID NO: 213 - DNA, 25 bp, Artificial Sequence
  Synthetic Oligonucleotide
caacuggcaguagccaugggcccaa

SEQ ID NO: 214 - DNA, 25 bp, Artificial Sequence
  Synthetic Oligonucleotide
agcaagaacaauguucgagcugctg

SEQ ID NO: 215 - DNA, 25 bp, Artificial Sequence
  Synthetic Oligonucleotide
caagaacaauguucgagcugcugcc

SEQ ID NO: 216 - DNA, 25 bp, Artificial Sequence
  Synthetic Oligonucleotide
agaacaauguucgagcugcugccct

SEQ ID NO: 217 - DNA, 25 bp, Artificial Sequence
  Synthetic Oligonucleotide
aacaauguucgagcugcugcccuag

SEQ ID NO: 218 - DNA, 25 bp, Artificial Sequence
  Synthetic Oligonucleotide
caauguucgagcugcugcccuagcg

SEQ ID NO: 219 - DNA, 25 bp, Artificial Sequence
  Synthetic Oligonucleotide
auguucgagcugcugcccuagcgac

SEQ ID NO: 220 - DNA, 25 bp, Artificial Sequence
  Synthetic Oligonucleotide
guucgagcugcugcccuagcgactg

SEQ ID NO: 221 - DNA, 25 bp, Artificial Sequence
  Synthetic Oligonucleotide
acugugaaugcuugggcagaacaga

SEQ ID NO: 222 - DNA, 25 bp, Artificial Sequence
  Synthetic Oligonucleotide
ugugaaugcuugggcagaacagact

SEQ ID NO: 223 - DNA, 25 bp, Artificial Sequence
  Synthetic Oligonucleotide
ugaaugcuugggcagaacagacugg

SEQ ID NO: 224 - DNA, 25 bp, Artificial Sequence
  Synthetic Oligonucleotide
gagaagaucuuucugaagagcucaa

SEQ ID NO: 225 - DNA, 25 bp, Artificial Sequence
  Synthetic Oligonucleotide
cuagaagaucgaaauggagaugugc

SEQ ID NO: 226 - DNA, 25 bp, Artificial Sequence
  Synthetic Oligonucleotide
agaagaucgaaauggagaugugcga

SEQ ID NO: 227 - DNA, 25 bp, Artificial Sequence
  Synthetic Oligonucleotide
aagaucgaaauggagaugugcgaaa

SEQ ID NO: 228 - DNA, 25 bp, Artificial Sequence
  Synthetic Oligonucleotide
ugaugcauuuaggauaugaaaaaat

SEQ ID NO: 229 - DNA, 25 bp, Artificial Sequence
  Synthetic Oligonucleotide
augcauuuaggauaugaaaaaaugg

SEQ ID NO: 230 - DNA, 25 bp, Artificial Sequence
  Synthetic Oligonucleotide
gcauuuaggauaugaaaaaauggcc

SEQ ID NO: 231 - DNA, 25 bp, Artificial Sequence
  Synthetic Oligonucleotide
auuuaggauaugaaaaaauggccaa

SEQ ID NO: 232 - DNA, 25 bp, Artificial Sequence
  Synthetic Oligonucleotide
uuaggauaugaaaaaauggccaagg

SEQ ID NO: 233 - DNA, 25 bp, Artificial Sequence
  Synthetic Oligonucleotide
aaggcuacugggaaacuaaagccaa

SEQ ID NO: 234 - DNA, 25 bp, Artificial Sequence
  Synthetic Oligonucleotide
ggcuacugggaaacuaaagccaact

SEQ ID NO: 235 - DNA, 25 bp, Artificial Sequence
  Synthetic Oligonucleotide
cuacugggaaacuaaagccaacutc

SEQ ID NO: 236 - DNA, 25 bp, Artificial Sequence
  Synthetic Oligonucleotide
acugggaaacuaaagccaacuucta

SEQ ID NO: 237 - DNA, 25 bp, Artificial Sequence
  Synthetic Oligonucleotide
ugggaaacuaaagccaacuucuaaa

SEQ ID NO: 238 - DNA, 25 bp, Artificial Sequence
  Synthetic Oligonucleotide
ggaaacuaaagccaacuucuaaaga

SEQ ID NO: 239 - DNA, 25 bp, Artificial Sequence
  Synthetic Oligonucleotide
aaacuaaagccaacuucuaaagatc

SEQ ID NO: 240 - DNA, 25 bp, Artificial Sequence
  Synthetic Oligonucleotide
acuaaagccaacuucuaaagaucag

SEQ ID NO: 241 - DNA, 25 bp, Artificial Sequence
  Synthetic Oligonucleotide
uaaagccaacuucuaaagaucaggt

SEQ ID NO: 242 - DNA, 25 bp, Artificial Sequence
  Synthetic Oligonucleotide
aagccaacuucuaaagaucagguat

SEQ ID NO: 243 - DNA, 25 bp, Artificial Sequence
  Synthetic Oligonucleotide
ccuauuuuuauuguuguuccaaatg

SEQ ID NO: 244 - DNA, 25 bp, Artificial Sequence
  Synthetic Oligonucleotide
uauuuuuauuguuguuccaaaugga

SEQ ID NO: 245 - DNA, 25 bp, Artificial Sequence
  Synthetic Oligonucleotide
uuuuuauuguuguuccaaauggaaa

SEQ ID NO: 246 - DNA, 25 bp, Artificial Sequence
  Synthetic Oligonucleotide
uuuauuguuguuccaaauggaaaag

SEQ ID NO: 247 - DNA, 25 bp, Artificial Sequence
  Synthetic Oligonucleotide
uauuguuguuccaaauggaaaagag

SEQ ID NO: 248 - DNA, 25 bp, Artificial Sequence
  Synthetic Oligonucleotide
uuguuguuccaaauggaaaagagca

SEQ ID NO: 249 - DNA, 25 bp, Artificial Sequence
  Synthetic Oligonucleotide
aggugcuaaaguggaauuuuacuac

SEQ ID NO: 250 - DNA, 25 bp, Artificial Sequence
  Synthetic Oligonucleotide
gugcuaaaguggaauuuuacuaccc

SEQ ID NO: 251 - DNA, 25 bp, Artificial Sequence
  Synthetic Oligonucleotide
aucaucuuacugagaaugaagcatc

SEQ ID NO: 252 - DNA, 25 bp, Artificial Sequence
  Synthetic Oligonucleotide
caucuuacugagaaugaagcauctt

SEQ ID NO: 253 - DNA, 25 bp, Artificial Sequence
  Synthetic Oligonucleotide
ucuuacugagaaugaagcaucuucc

SEQ ID NO: 254 - DNA, 25 bp, Artificial Sequence
  Synthetic Oligonucleotide
uuacugagaaugaagcaucuucctt

SEQ ID NO: 255 - DNA, 25 bp, Artificial Sequence
  Synthetic Oligonucleotide
caagguuggagaaccaaaggaugtc

SEQ ID NO: 256 - DNA, 25 bp, Artificial Sequence
  Synthetic Oligonucleotide
agguuggagaaccaaaggaugucat

SEQ ID NO: 257 - DNA, 25 bp, Artificial Sequence
  Synthetic Oligonucleotide
guuggagaaccaaaggaugucautc

SEQ ID NO: 258 - DNA, 25 bp, Artificial Sequence
  Synthetic Oligonucleotide
uggagaaccaaaggaugucauucgt

SEQ ID NO: 259 - DNA, 25 bp, Artificial Sequence
  Synthetic Oligonucleotide
gagaaccaaaggaugucauucguaa

SEQ ID NO: 260 - DNA, 25 bp, Artificial Sequence
  Synthetic Oligonucleotide
gaaccaaaggaugucauucguaaag

SEQ ID NO: 261 - DNA, 25 bp, Artificial Sequence
  Synthetic Oligonucleotide
accaaaggaugucauucguaaagat

SEQ ID NO: 262 - DNA, 25 bp, Artificial Sequence
  Synthetic Oligonucleotide
caaaggaugucauucguaaagaugt

SEQ ID NO: 263 - DNA, 25 bp, Artificial Sequence
  Synthetic Oligonucleotide
aaggaugucauucguaaagaugutc

SEQ ID NO: 264 - DNA, 25 bp, Artificial Sequence
  Synthetic Oligonucleotide
ggaugucauucguaaagauguucgt

SEQ ID NO: 265 - DNA, 25 bp, Artificial Sequence
  Synthetic Oligonucleotide
augucauucguaaagauguucgugc

SEQ ID NO: 266 - DNA, 25 bp, Artificial Sequence
  Synthetic Oligonucleotide
uccugaaccggaugugccuugucta

SEQ ID NO: 267 - DNA, 25 bp, Artificial Sequence
  Synthetic Oligonucleotide
cugaaccggaugugccuugucuacc

SEQ ID NO: 268 - DNA, 25 bp, Artificial Sequence
  Synthetic Oligonucleotide
gaaccggaugugccuugucuaccca

SEQ ID NO: 269 - DNA, 25 bp, Artificial Sequence
  Synthetic Oligonucleotide
accggaugugccuugucuacccagc

SEQ ID NO: 270 - DNA, 25 bp, Artificial Sequence
  Synthetic Oligonucleotide
cggaugugccuugucuacccagcta

SEQ ID NO: 271 - DNA, 25 bp, Artificial Sequence
  Synthetic Oligonucleotide
gaugugccuugucuacccagcuagc

SEQ ID NO: 272 - DNA, 25 bp, Artificial Sequence
  Synthetic Oligonucleotide
ugugccuugucuacccagcuagcaa

SEQ ID NO: 273 - DNA, 25 bp, Artificial Sequence
  Synthetic Oligonucleotide
ccaaaaacucuaagcagagagcaga

SEQ ID NO: 274 - DNA, 25 bp, Artificial Sequence
  Synthetic Oligonucleotide
aaaaacucuaagcagagagcagagt

SEQ ID NO: 275 - DNA, 25 bp, Artificial Sequence
  Synthetic Oligonucleotide
aaacucuaagcagagagcagagugc

SEQ ID NO: 276 - DNA, 25 bp, Artificial Sequence
  Synthetic Oligonucleotide
acucuaagcagagagcagagugcct

SEQ ID NO: 277 - DNA, 25 bp, Artificial Sequence
  Synthetic Oligonucleotide
ucuaagcagagagcagagugccugg

SEQ ID NO: 278 - DNA, 25 bp, Artificial Sequence
  Synthetic Oligonucleotide
uaagcagagagcagagugccuggaa

SEQ ID NO: 279 - DNA, 25 bp, Artificial Sequence
  Synthetic Oligonucleotide
agcagagagcagagugccuggaaga

SEQ ID NO: 280 - DNA, 25 bp, Artificial Sequence
  Synthetic Oligonucleotide
cagagagcagagugccuggaagagc

SEQ ID NO: 281 - DNA, 25 bp, Artificial Sequence
  Synthetic Oligonucleotide
gagagcagagugccuggaagagctg

SEQ ID NO: 282 - DNA, 25 bp, Artificial Sequence
  Synthetic Oligonucleotide
gagcagagugccuggaagagcuggg

SEQ ID NO: 283 - DNA, 25 bp, Artificial Sequence
  Synthetic Oligonucleotide
gcagagugccuggaagagcugggat

SEQ ID NO: 284 - DNA, 25 bp, Artificial Sequence
  Synthetic Oligonucleotide
caggaaaagccuuaaaggaaauagc

SEQ ID NO: 285 - DNA, 25 bp, Artificial Sequence
  Synthetic Oligonucleotide
aucagguguucaaacugauuggaaa

SEQ ID NO: 286 - DNA, 25 bp, Artificial Sequence
  Synthetic Oligonucleotide
cagguguucaaacugauuggaaatc

SEQ ID NO: 287 - DNA, 25 bp, Artificial Sequence
  Synthetic Oligonucleotide
gguguucaaacugauuggaaauctt

SEQ ID NO: 288 - DNA, 25 bp, Artificial Sequence
  Synthetic Oligonucleotide
uguucaaacugauuggaaaucuutc

SEQ ID NO: 289 - DNA, 25 bp, Artificial Sequence
  Synthetic Oligonucleotide
uucaaacugauuggaaaucuuuctg

SEQ ID NO: 290 - DNA, 25 bp, Artificial Sequence
  Synthetic Oligonucleotide
caaacugauuggaaaucuuucugaa

SEQ ID NO: 291 - DNA, 25 bp, Artificial Sequence
  Synthetic Oligonucleotide
aacugauuggaaaucuuucugaaaa

SEQ ID NO: 292 - DNA, 25 bp, Artificial Sequence
  Synthetic Oligonucleotide
cugauuggaaaucuuucugaaaagg

SEQ ID NO: 293 - DNA, 25 bp, Artificial Sequence
  Synthetic Oligonucleotide
aagcggucagcaaagagacccuctg

SEQ ID NO: 294 - DNA, 25 bp, Artificial Sequence
  Synthetic Oligonucleotide
gcggucagcaaagagacccucugct

SEQ ID NO: 295 - DNA, 25 bp, Artificial Sequence
  Synthetic Oligonucleotide
ggucagcaaagagacccucugcugc

SEQ ID NO: 296 - DNA, 25 bp, Artificial Sequence
  Synthetic Oligonucleotide
ucagcaaagagacccucugcugcac

SEQ ID NO: 297 - DNA, 25 bp, Artificial Sequence
  Synthetic Oligonucleotide
agcaaagagacccucugcugcacca

SEQ ID NO: 298 - DNA, 25 bp, Artificial Sequence
  Synthetic Oligonucleotide
caaagagacccucugcugcaccaat

SEQ ID NO: 299 - DNA, 25 bp, Artificial Sequence
  Synthetic Oligonucleotide
aagagacccucugcugcaccaauaa

SEQ ID NO: 300 - DNA, 25 bp, Artificial Sequence
  Synthetic Oligonucleotide
uacgcaagggaccagcugaggacat

SEQ ID NO: 301 - DNA, 25 bp, Artificial Sequence
  Synthetic Oligonucleotide
cgcaagggaccagcugaggacaugt

SEQ ID NO: 302 - DNA, 25 bp, Artificial Sequence
  Synthetic Oligonucleotide
cgccgagaauuccagcuggaucuag

SEQ ID NO: 303 - DNA, 25 bp, Artificial Sequence
  Synthetic Oligonucleotide
ccgagaauuccagcuggaucuagat

SEQ ID NO: 304 - DNA, 25 bp, Artificial Sequence
  Synthetic Oligonucleotide
agauccgggcuguuucuccacactt

SEQ ID NO: 305 - DNA, 25 bp, Artificial Sequence
  Synthetic Oligonucleotide
auccgggcuguuucuccacacuucg

SEQ ID NO: 306 - DNA, 25 bp, Artificial Sequence
  Synthetic Oligonucleotide
gaugacaugcacaguaauacagcat

SEQ ID NO: 307 - DNA, 25 bp, Artificial Sequence
  Synthetic Oligonucleotide
ugacaugcacaguaauacagcaucc

SEQ ID NO: 308 - DNA, 25 bp, Artificial Sequence
  Synthetic Oligonucleotide
acaugcacaguaauacagcauccac

SEQ ID NO: 309 - DNA, 25 bp, Artificial Sequence
  Synthetic Oligonucleotide
augcacaguaauacagcauccacaa

SEQ ID NO: 310 - DNA, 25 bp, Artificial Sequence
  Synthetic Oligonucleotide
gcacaguaauacagcauccacaatc

SEQ ID NO: 311 - DNA, 25 bp, Artificial Sequence
  Synthetic Oligonucleotide
acaguaauacagcauccacaaucaa

SEQ ID NO: 312 - DNA, 25 bp, Artificial Sequence
  Synthetic Oligonucleotide
aguaauacagcauccacaaucaatt

SEQ ID NO: 313 - DNA, 25 bp, Artificial Sequence
  Synthetic Oligonucleotide
uaauacagcauccacaaucaauutc

SEQ ID NO: 314 - DNA, 25 bp, Artificial Sequence
  Synthetic Oligonucleotide
auacagcauccacaaucaauuucat

SEQ ID NO: 315 - DNA, 25 bp, Artificial Sequence
  Synthetic Oligonucleotide
acagcauccacaaucaauuucauta

SEQ ID NO: 316 - DNA, 25 bp, Artificial Sequence
  Synthetic Oligonucleotide
agcauccacaaucaauuucauuatc

SEQ ID NO: 317 - DNA, 25 bp, Artificial Sequence
  Synthetic Oligonucleotide
cauccacaaucaauuucauuauctc

SEQ ID NO: 318 - DNA, 25 bp, Artificial Sequence
  Synthetic Oligonucleotide
uccacaaucaauuucauuaucuccc

SEQ ID NO: 319 - DNA, 25 bp, Artificial Sequence
  Synthetic Oligonucleotide
cacaaucaauuucauuaucucccaa

SEQ ID NO: 320 - DNA, 25 bp, Artificial Sequence
  Synthetic Oligonucleotide
caaucaauuucauuaucucccaagt

SEQ ID NO: 321 - DNA, 25 bp, Artificial Sequence
  Synthetic Oligonucleotide
aucaauuucauuaucucccaaguag

SEQ ID NO: 322 - DNA, 25 bp, Artificial Sequence
  Synthetic Oligonucleotide
caauuucauuaucucccaaguagcc

SEQ ID NO: 323 - DNA, 25 bp, Artificial Sequence
  Synthetic Oligonucleotide
auuucauuaucucccaaguagccag

SEQ ID NO: 324 - DNA, 25 bp, Artificial Sequence
  Synthetic Oligonucleotide
uucauuaucucccaaguagccagtg

SEQ ID NO: 325 - DNA, 25 bp, Artificial Sequence
  Synthetic Oligonucleotide
cauuaucucccaaguagccaguggt

SEQ ID NO: 326 - DNA, 25 bp, Artificial Sequence
  Synthetic Oligonucleotide
uuaucucccaaguagccagugguga

SEQ ID NO: 327 - DNA, 25 bp, Artificial Sequence
  Synthetic Oligonucleotide
aucucccaaguagccaguggugaca

SEQ ID NO: 328 - DNA, 25 bp, Artificial Sequence
  Synthetic Oligonucleotide
cucccaaguagccaguggugacatc

SEQ ID NO: 329 - DNA, 25 bp, Artificial Sequence
  Synthetic Oligonucleotide
cccaaguagccaguggugacaucaa

SEQ ID NO: 330 - DNA, 25 bp, Artificial Sequence
  Synthetic Oligonucleotide
caaguagccaguggugacaucaaca

SEQ ID NO: 331 - DNA, 25 bp, Artificial Sequence
  Synthetic Oligonucleotide
gcccgggaggccuccacuggaguac

SEQ ID NO: 332 - DNA, 25 bp, Artificial Sequence
  Synthetic Oligonucleotide
ccgggaggccuccacuggaguacta

SEQ ID NO: 333 - DNA, 25 bp, Artificial Sequence
  Synthetic Oligonucleotide
gggaggccuccacuggaguacuaaa

SEQ ID NO: 334 - DNA, 25 bp, Artificial Sequence
  Synthetic Oligonucleotide
gaggccuccacuggaguacuaaaag

SEQ ID NO: 335 - DNA, 25 bp, Artificial Sequence
  Synthetic Oligonucleotide
aucaccuuaaugcuggauucucgga

SEQ ID NO: 336 - DNA, 25 bp, Artificial Sequence
  Synthetic Oligonucleotide
caccuuaaugcuggauucucggatt

SEQ ID NO: 337 - DNA, 25 bp, Artificial Sequence
  Synthetic Oligonucleotide
ccuuaaugcuggauucucggauuga

SEQ ID NO: 338 - DNA, 25 bp, Artificial Sequence
  Synthetic Oligonucleotide
uuaaugcuggauucucggauugaag

SEQ ID NO: 339 - DNA, 25 bp, Artificial Sequence
  Synthetic Oligonucleotide
aaugcuggauucucggauugaagat

SEQ ID NO: 340 - DNA, 25 bp, Artificial Sequence
  Synthetic Oligonucleotide
ugcuggauucucggauugaagauct

SEQ ID NO: 341 - DNA, 25 bp, Artificial Sequence
  Synthetic Oligonucleotide
cuggauucucggauugaagaucutg

SEQ ID NO: 342 - DNA, 25 bp, Artificial Sequence
  Synthetic Oligonucleotide
ggauucucggauugaagaucuugag

SEQ ID NO: 343 - DNA, 25 bp, Artificial Sequence
  Synthetic Oligonucleotide
auucucggauugaagaucuugagga

SEQ ID NO: 344 - DNA, 25 bp, Artificial Sequence
  Synthetic Oligonucleotide
cugugaaccucuugguggugaaggt

SEQ ID NO: 345 - DNA, 25 bp, Artificial Sequence
  Synthetic Oligonucleotide
gugaaccucuugguggugaaggutc

SEQ ID NO: 346 - DNA, 25 bp, Artificial Sequence
  Synthetic Oligonucleotide
gaaccucuugguggugaagguuctg

SEQ ID NO: 347 - DNA, 25 bp, Artificial Sequence
  Synthetic Oligonucleotide
accucuugguggugaagguucugga

SEQ ID NO: 348 - DNA, 25 bp, Artificial Sequence
  Synthetic Oligonucleotide
gacagccugcuagcaacagccagtt

SEQ ID NO: 349 - DNA, 25 bp, Artificial Sequence
  Synthetic Oligonucleotide
aguucucccaaauucucagagcutg

SEQ ID NO: 350 - DNA, 25 bp, Artificial Sequence
  Synthetic Oligonucleotide
uucucccaaauucucagagcuugtt

SEQ ID NO: 351 - DNA, 25 bp, Artificial Sequence
  Synthetic Oligonucleotide
cucccaaauucucagagcuuguuat

SEQ ID NO: 352 - DNA, 25 bp, Artificial Sequence
  Synthetic Oligonucleotide
cccaaauucucagagcuuguuauga

SEQ ID NO: 353 - DNA, 25 bp, Artificial Sequence
  Synthetic Oligonucleotide
caaauucucagagcuuguuaugaag

SEQ ID NO: 354 - DNA, 25 bp, Artificial Sequence
  Synthetic Oligonucleotide
aauucucagagcuuguuaugaagtg

SEQ ID NO: 355 - DNA, 25 bp, Artificial Sequence
  Synthetic Oligonucleotide
uucucagagcuuguuaugaagugtc

SEQ ID NO: 356 - DNA, 25 bp, Artificial Sequence
  Synthetic Oligonucleotide
cucagagcuuguuaugaaguguctc

SEQ ID NO: 357 - DNA, 25 bp, Artificial Sequence
  Synthetic Oligonucleotide
cagagcuuguuaugaagugucuctg

SEQ ID NO: 358 - DNA, 25 bp, Artificial Sequence
  Synthetic Oligonucleotide
gagcuuguuaugaagugucucugga

SEQ ID NO: 359 - DNA, 25 bp, Artificial Sequence
  Synthetic Oligonucleotide
agcauuaaccuagacagaauucutc

SEQ ID NO: 360 - DNA, 25 bp, Artificial Sequence
  Synthetic Oligonucleotide
cauuaaccuagacagaauucuuctg

SEQ ID NO: 361 - DNA, 25 bp, Artificial Sequence
  Synthetic Oligonucleotide
uuaaccuagacagaauucuucugga

SEQ ID NO: 362 - DNA, 25 bp, Artificial Sequence
  Synthetic Oligonucleotide
aaccuagacagaauucuucuggata

SEQ ID NO: 363 - DNA, 25 bp, Artificial Sequence
  Synthetic Oligonucleotide
ccuagacagaauucuucuggauatc

SEQ ID NO: 364 - DNA, 25 bp, Artificial Sequence
  Synthetic Oligonucleotide
uagacagaauucuucuggauaucca

SEQ ID NO: 365 - DNA, 25 bp, Artificial Sequence
  Synthetic Oligonucleotide
uccacauuuucaugaaggucuuccc

SEQ ID NO: 366 - DNA, 25 bp, Artificial Sequence
  Synthetic Oligonucleotide
gaagcaaugcaaaagugaauuuccc

SEQ ID NO: 367 - DNA, 25 bp, Artificial Sequence
  Synthetic Oligonucleotide
agcaaugcaaaagugaauuucccat

SEQ ID NO: 368 - DNA, 25 bp, Artificial Sequence
  Synthetic Oligonucleotide
caaugcaaaagugaauuucccauaa

SEQ ID NO: 369 - DNA, 25 bp, Artificial Sequence
  Synthetic Oligonucleotide
aguauggaccagacugggagcaagt

SEQ ID NO: 370 - DNA, 25 bp, Artificial Sequence
  Synthetic Oligonucleotide
uauggaccagacugggagcaaguct

SEQ ID NO: 371 - DNA, 25 bp, Artificial Sequence
  Synthetic Oligonucleotide
uggaccagacugggagcaagucuga

SEQ ID NO: 372 - DNA, 25 bp, Artificial Sequence
  Synthetic Oligonucleotide
gaccagacugggagcaagucugata

SEQ ID NO: 373 - DNA, 25 bp, Artificial Sequence
  Synthetic Oligonucleotide
ccagacugggagcaagucugauaag

SEQ ID NO: 374 - DNA, 25 bp, Artificial Sequence
  Synthetic Oligonucleotide
agacugggagcaagucugauaagga

SEQ ID NO: 375 - DNA, 25 bp, Artificial Sequence
  Synthetic Oligonucleotide
acugggagcaagucugauaaggaaa

SEQ ID NO: 376 - DNA, 25 bp, Artificial Sequence
  Synthetic Oligonucleotide
ugggagcaagucugauaaggaaaca

SEQ ID NO: 377 - DNA, 25 bp, Artificial Sequence
  Synthetic Oligonucleotide
ggagcaagucugauaaggaaacaga

SEQ ID NO: 378 - DNA, 25 bp, Artificial Sequence
  Synthetic Oligonucleotide
agcaagucugauaaggaaacagaaa

SEQ ID NO: 379 - DNA, 25 bp, Artificial Sequence
  Synthetic Oligonucleotide
caagucugauaaggaaacagaaaag

SEQ ID NO: 380 - DNA, 25 bp, Artificial Sequence
  Synthetic Oligonucleotide
agucugauaaggaaacagaaaaggg

SEQ ID NO: 381 - DNA, 25 bp, Artificial Sequence
  Synthetic Oligonucleotide
ucugauaaggaaacagaaaagggag

SEQ ID NO: 382 - DNA, 25 bp, Artificial Sequence
  Synthetic Oligonucleotide
ugauaaggaaacagaaaagggagca

SEQ ID NO: 383 - DNA, 25 bp, Artificial Sequence
  Synthetic Oligonucleotide
auaaggaaacagaaaagggagcatc

SEQ ID NO: 384 - DNA, 25 bp, Artificial Sequence
  Synthetic Oligonucleotide
aaggaaacagaaaagggagcauctc

SEQ ID NO: 385 - DNA, 25 bp, Artificial Sequence
  Synthetic Oligonucleotide
ucucgaauagaugaaaaaucaucaa

SEQ ID NO: 386 - DNA, 25 bp, Artificial Sequence
  Synthetic Oligonucleotide
ucgaauagaugaaaaaucaucaaag

SEQ ID NO: 387 - DNA, 25 bp, Artificial Sequence
  Synthetic Oligonucleotide
gaauagaugaaaaaucaucaaaggc

SEQ ID NO: 388 - DNA, 25 bp, Artificial Sequence
  Synthetic Oligonucleotide
auagaugaaaaaucaucaaaggcca

SEQ ID NO: 389 - DNA, 25 bp, Artificial Sequence
  Synthetic Oligonucleotide
agaugaaaaaucaucaaaggccaaa

SEQ ID NO: 390 - DNA, 25 bp, Artificial Sequence
  Synthetic Oligonucleotide
augaaaaaucaucaaaggccaaagt

SEQ ID NO: 391 - DNA, 25 bp, Artificial Sequence
  Synthetic Oligonucleotide
gaaaaaucaucaaaggccaaaguga

SEQ ID NO: 392 - DNA, 25 bp, Artificial Sequence
  Synthetic Oligonucleotide
aaaaucaucaaaggccaaagugaat

SEQ ID NO: 393 - DNA, 25 bp, Artificial Sequence
  Synthetic Oligonucleotide
aaucaucaaaggccaaagugaauga

SEQ ID NO: 394 - DNA, 25 bp, Artificial Sequence
  Synthetic Oligonucleotide
augauuucuuagcugagauuuuuaa

SEQ ID NO: 395 - DNA, 25 bp, Artificial Sequence
  Synthetic Oligonucleotide
gauuucuuagcugagauuuuuaaga

SEQ ID NO: 396 - DNA, 25 bp, Artificial Sequence
  Synthetic Oligonucleotide
uuucuuagcugagauuuuuaagaag

SEQ ID NO: 397 - DNA, 25 bp, Artificial Sequence
  Synthetic Oligonucleotide
ucuuagcugagauuuuuaagaagat

SEQ ID NO: 398 - DNA, 25 bp, Artificial Sequence
  Synthetic Oligonucleotide
uuagcugagauuuuuaagaagautg

SEQ ID NO: 399 - DNA, 25 bp, Artificial Sequence
  Synthetic Oligonucleotide
agcugagauuuuuaagaagauuggc

SEQ ID NO: 400 - DNA, 25 bp, Artificial Sequence
  Synthetic Oligonucleotide
cugagauuuuuaagaagauuggctc

SEQ ID NO: 401 - DNA, 25 bp, Artificial Sequence
  Synthetic Oligonucleotide
gagauuuuuaagaagauuggcucta

SEQ ID NO: 402 - DNA, 25 bp, Artificial Sequence
  Synthetic Oligonucleotide
gauuuuuaagaagauuggcucuaaa

SEQ ID NO: 403 - DNA, 25 bp, Artificial Sequence
  Synthetic Oligonucleotide
uuuuuaagaagauuggcucuaaaga

SEQ ID NO: 404 - DNA, 25 bp, Artificial Sequence
  Synthetic Oligonucleotide
uagcagaguuauaugaauauaagaa

SEQ ID NO: 405 - DNA, 25 bp, Artificial Sequence
  Synthetic Oligonucleotide
gcagaguuauaugaauauaagaaga

SEQ ID NO: 406 - DNA, 25 bp, Artificial Sequence
  Synthetic Oligonucleotide
agaguuauaugaauauaagaagaaa

SEQ ID NO: 407 - DNA, 25 bp, Artificial Sequence
  Synthetic Oligonucleotide
aguuauaugaauauaagaagaaata

SEQ ID NO: 408 - DNA, 25 bp, Artificial Sequence
  Synthetic Oligonucleotide
uuauaugaauauaagaagaaauact

SEQ ID NO: 409 - DNA, 25 bp, Artificial Sequence
  Synthetic Oligonucleotide
auaugaauauaagaagaaauacuca

SEQ ID NO: 410 - DNA, 25 bp, Artificial Sequence
  Synthetic Oligonucleotide
augaauauaagaagaaauacucaga

SEQ ID NO: 411 - DNA, 25 bp, Artificial Sequence
  Synthetic Oligonucleotide
ugacauugaaccauuucugaaaaat

SEQ ID NO: 412 - DNA, 25 bp, Artificial Sequence
  Synthetic Oligonucleotide
acauugaaccauuucugaaaaautc

SEQ ID NO: 413 - DNA, 25 bp, Artificial Sequence
  Synthetic Oligonucleotide
auugaaccauuucugaaaaauucct

SEQ ID NO: 414 - DNA, 25 bp, Artificial Sequence
  Synthetic Oligonucleotide
ugaaccauuucugaaaaauuccuca

SEQ ID NO: 415 - DNA, 25 bp, Artificial Sequence
  Synthetic Oligonucleotide
aaccauuucugaaaaauuccucaca

SEQ ID NO: 416 - DNA, 25 bp, Artificial Sequence
  Synthetic Oligonucleotide
ccauuucugaaaaauuccucacagt

SEQ ID NO: 417 - DNA, 25 bp, Artificial Sequence
  Synthetic Oligonucleotide
agaggccuucgggugauugagaugg

SEQ ID NO: 418 - DNA, 25 bp, Artificial Sequence
  Synthetic Oligonucleotide
aggccuucgggugauugagauggag

SEQ ID NO: 419 - DNA, 25 bp, Artificial Sequence
  Synthetic Oligonucleotide
gccuucgggugauugagauggagag

SEQ ID NO: 420 - DNA, 25 bp, Artificial Sequence
  Synthetic Oligonucleotide
cuucgggugauugagauggagaggg

SEQ ID NO: 421 - DNA, 25 bp, Artificial Sequence
  Synthetic Oligonucleotide
ucgggugauugagauggagagggag

SEQ ID NO: 422 - DNA, 25 bp, Artificial Sequence
  Synthetic Oligonucleotide
gggugauugagauggagagggaggg

SEQ ID NO: 423 - DNA, 25 bp, Artificial Sequence
  Synthetic Oligonucleotide
ccaucugucuacuuggaaaggcuaa

SEQ ID NO: 424 - DNA, 25 bp, Artificial Sequence
  Synthetic Oligonucleotide
aucugucuacuuggaaaggcuaaag

SEQ ID NO: 425 - DNA, 25 bp, Artificial Sequence
  Synthetic Oligonucleotide
cugucuacuuggaaaggcuaaagat

SEQ ID NO: 426 - DNA, 25 bp, Artificial Sequence
  Synthetic Oligonucleotide
gucuacuuggaaaggcuaaagaucc

SEQ ID NO: 427 - DNA, 25 bp, Artificial Sequence
  Synthetic Oligonucleotide
ugaccucuuugcucuccaaaccagc

SEQ ID NO: 428 - DNA, 25 bp, Artificial Sequence
  Synthetic Oligonucleotide
accucuuugcucuccaaaccagcag

SEQ ID NO: 429 - DNA, 25 bp, Artificial Sequence
  Synthetic Oligonucleotide
cucuuugcucuccaaaccagcagtt

SEQ ID NO: 430 - DNA, 25 bp, Artificial Sequence
  Synthetic Oligonucleotide
cuuugcucuccaaaccagcaguucc

SEQ ID NO: 431 - DNA, 25 bp, Artificial Sequence
  Synthetic Oligonucleotide
ugaccuccuccuccuccacagcuaa

SEQ ID NO: 432 - DNA, 25 bp, Artificial Sequence
  Synthetic Oligonucleotide
agacuggagagaauaaagagcagtc

SEQ ID NO: 433 - DNA, 25 bp, Artificial Sequence
  Synthetic Oligonucleotide
acuggagagaauaaagagcagucgc

SEQ ID NO: 434 - DNA, 25 bp, Artificial Sequence
  Synthetic Oligonucleotide
uggagagaauaaagagcagucgcaa

SEQ ID NO: 435 - DNA, 25 bp, Artificial Sequence
  Synthetic Oligonucleotide
gagagaauaaagagcagucgcaaat

SEQ ID NO: 436 - DNA, 25 bp, Artificial Sequence
  Synthetic Oligonucleotide
gagaauaaagagcagucgcaaauga

SEQ ID NO: 437 - DNA, 25 bp, Artificial Sequence
  Synthetic Oligonucleotide
gaauaaagagcagucgcaaaugaag

SEQ ID NO: 438 - DNA, 25 bp, Artificial Sequence
  Synthetic Oligonucleotide
auaaagagcagucgcaaaugaagct

SEQ ID NO: 439 - DNA, 25 bp, Artificial Sequence
  Synthetic Oligonucleotide
aaagagcagucgcaaaugaagcugc

SEQ ID NO: 440 - DNA, 25 bp, Artificial Sequence
  Synthetic Oligonucleotide
agagcagucgcaaaugaagcugccc

SEQ ID NO: 441 - DNA, 25 bp, Artificial Sequence
  Synthetic Oligonucleotide
aaacugguuguauguaucaugccgt

SEQ ID NO: 442 - DNA, 25 bp, Artificial Sequence
  Synthetic Oligonucleotide
cucauuuguaaaauuguccuaauct

SEQ ID NO: 443 - DNA, 25 bp, Artificial Sequence
  Synthetic Oligonucleotide
cauuuguaaaauuguccuaaucutt

SEQ ID NO: 444 - DNA, 25 bp, Artificial Sequence
  Synthetic Oligonucleotide
uuuguaaaauuguccuaaucuuucc

SEQ ID NO: 445 - DNA, 25 bp, Artificial Sequence
  Synthetic Oligonucleotide
acuguauucuguaugaaugcauggc

SEQ ID NO: 446 - DNA, 25 bp, Artificial Sequence
  Synthetic Oligonucleotide
uguauucuguaugaaugcauggcat

SEQ ID NO: 447 - DNA, 25 bp, Artificial Sequence
  Synthetic Oligonucleotide
uauucuguaugaaugcauggcauga

SEQ ID NO: 448 - DNA, 25 bp, Artificial Sequence
  Synthetic Oligonucleotide
uucuguaugaaugcauggcaugata

SEQ ID NO: 449 - DNA, 25 bp, Artificial Sequence
  Synthetic Oligonucleotide
cuguaugaaugcauggcaugauaca

SEQ ID NO: 450 - DNA, 25 bp, Artificial Sequence
  Synthetic Oligonucleotide
guaugaaugcauggcaugauacaac

SEQ ID NO: 451 - DNA, 25 bp, Artificial Sequence
  Synthetic Oligonucleotide
uuuuauaaauaaaguuugcauuaac

SEQ ID NO: 452 - DNA, 25 bp, Artificial Sequence
  Synthetic Oligonucleotide
uuauaaauaaaguuugcauuaacta

SEQ ID NO: 453 - DNA, 25 bp, Artificial Sequence
  Synthetic Oligonucleotide
auaaauaaaguuugcauuaacuata

SEQ ID NO: 454 - DNA, 25 bp, Artificial Sequence
  Synthetic Oligonucleotide
aaauaaaguuugcauuaacuauacc

SEQ ID NO: 455 - DNA, 25 bp, Artificial Sequence
  Synthetic Oligonucleotide
auaaaguuugcauuaacuauacctg

SEQ ID NO: 456 - DNA, 25 bp, Artificial Sequence
  Synthetic Oligonucleotide
aaaguuugcauuaacuauaccugac

SEQ ID NO: 457 - DNA, 25 bp, Artificial Sequence
  Synthetic Oligonucleotide
cagcugaggaaauacucuuaauuct

SEQ ID NO: 458 - DNA, 25 bp, Artificial Sequence
  Synthetic Oligonucleotide
uugaaacugccaguugaucagaaat

SEQ ID NO: 459 - DNA, 25 bp, Artificial Sequence
  Synthetic Oligonucleotide
gccaguugaucagaaaugugaacac

SEQ ID NO: 460 - DNA, 25 bp, Artificial Sequence
  Synthetic Oligonucleotide
gaaagcaagguuaaguggguaugaa

SEQ ID NO: 461 - DNA, 25 bp, Artificial Sequence
  Synthetic Oligonucleotide
cagagugguccaaauuuuuaggatt

SEQ ID NO: 462 - DNA, 25 bp, Artificial Sequence
  Synthetic Oligonucleotide
gugguucaauugaaaggauuagaag

SEQ ID NO: 463 - DNA, 25 bp, Artificial Sequence
  Synthetic Oligonucleotide
gauuagaagcugcacuuguuuaugt

SEQ ID NO: 464 - DNA, 25 bp, Artificial Sequence
  Synthetic Oligonucleotide
cugcacuuguuuauguugaaaaugc

SEQ ID NO: 465 - DNA, 25 bp, Artificial Sequence
  Synthetic Oligonucleotide
caggaaaaaccacaggagaaguugt

SEQ ID NO: 466 - DNA, 25 bp, Artificial Sequence
  Synthetic Oligonucleotide
cagguguuguaaguaagguguucaa

SEQ ID NO: 467 - DNA, 25 bp, Artificial Sequence
  Synthetic Oligonucleotide
guuguaaguaagguguucaaucaac

SEQ ID NO: 468 - DNA, 25 bp, Artificial Sequence
  Synthetic Oligonucleotide
ucaaucaaccuaaagcuaaagccaa

SEQ ID NO: 469 - DNA, 25 bp, Artificial Sequence
  Synthetic Oligonucleotide
ccugaaaggcuuggacaauaagaat

SEQ ID NO: 470 - DNA, 25 bp, Artificial Sequence
  Synthetic Oligonucleotide
aagccaauuaucaaaguguugccaa

SEQ ID NO: 471 - DNA, 25 bp, Artificial Sequence
  Synthetic Oligonucleotide
aaaguguugccaaaacucuuugagt

SEQ ID NO: 472 - DNA, 25 bp, Artificial Sequence
  Synthetic Oligonucleotide
caaaacucuuugagucucgagagaa

SEQ ID NO: 473 - DNA, 25 bp, Artificial Sequence
  Synthetic Oligonucleotide
cuguucgagaugaagccaaacuaat

SEQ ID NO: 474 - DNA, 25 bp, Artificial Sequence
  Synthetic Oligonucleotide
cauuacaaaauauaaacucuguuca

SEQ ID NO: 475 - DNA, 25 bp, Artificial Sequence
  Synthetic Oligonucleotide
aaaauauaaacucuguucaguugaa

SEQ ID NO: 476 - DNA, 25 bp, Artificial Sequence
  Synthetic Oligonucleotide
auaaacucuguucaguugaaagaac

SEQ ID NO: 477 - DNA, 25 bp, Artificial Sequence
  Synthetic Oligonucleotide
cuguucaguugaaagaacuagaaga

SEQ ID NO: 478 - DNA, 25 bp, Artificial Sequence
  Synthetic Oligonucleotide
gaugaggugccacaaauagaugctt

SEQ ID NO: 479 - DNA, 25 bp, Artificial Sequence
  Synthetic Oligonucleotide
aaauagaugcuuaugagcuuuuaga

SEQ ID NO: 480 - DNA, 25 bp, Artificial Sequence
  Synthetic Oligonucleotide
augagcuuuuagaagcuguagaaat

SEQ ID NO: 481 - DNA, 25 bp, Artificial Sequence
  Synthetic Oligonucleotide
cccuggagucuguagaaguacuaat

SEQ ID NO: 482 - DNA, 25 bp, Artificial Sequence
  Synthetic Oligonucleotide
gagucuguagaaguacuaauaaaaa

SEQ ID NO: 483 - DNA, 25 bp, Artificial Sequence
  Synthetic Oligonucleotide
cagauuuaguaaaagcauuaaagaa

SEQ ID NO: 484 - DNA, 25 bp, Artificial Sequence
  Synthetic Oligonucleotide
aaaagcauuaaagaagguuguugga

SEQ ID NO: 485 - DNA, 25 bp, Artificial Sequence
  Synthetic Oligonucleotide
cauuaaagaagguuguuggaaagga

SEQ ID NO: 486 - DNA, 25 bp, Artificial Sequence
  Synthetic Oligonucleotide
gaagguuguuggaaaggacaccaat

SEQ ID NO: 487 - DNA, 25 bp, Artificial Sequence
  Synthetic Oligonucleotide
ggaagaaauuuggacaauaugcagg

SEQ ID NO: 488 - DNA, 25 bp, Artificial Sequence
  Synthetic Oligonucleotide
gugaggauguuuuagcaguaaugga

SEQ ID NO: 489 - DNA, 25 bp, Artificial Sequence
  Synthetic Oligonucleotide
guuuuagcaguaauggauaauaaaa

SEQ ID NO: 490 - DNA, 25 bp, Artificial Sequence
  Synthetic Oligonucleotide
caagcagcagacaucucuuuuuatt

SEQ ID NO: 491 - DNA, 25 bp, Artificial Sequence
  Synthetic Oligonucleotide
gacaucucuuuuuauugcaagaagt

SEQ ID NO: 492 - DNA, 25 bp, Artificial Sequence
  Synthetic Oligonucleotide
ucagagaugccgcauuugaagcatt

SEQ ID NO: 493 - DNA, 25 bp, Artificial Sequence
  Synthetic Oligonucleotide
cauuggguacugcuuugaagguggt

SEQ ID NO: 494 - DNA, 25 bp, Artificial Sequence
  Synthetic Oligonucleotide
guggacaaacucaagcuugauaaga

SEQ ID NO: 495 - DNA, 25 bp, Artificial Sequence
  Synthetic Oligonucleotide
aagaauguucagaaaagguagaact

SEQ ID NO: 496 - DNA, 25 bp, Artificial Sequence
  Synthetic Oligonucleotide
ucagaaaagguagaacugauacatg

SEQ ID NO: 497 - DNA, 25 bp, Artificial Sequence
  Synthetic Oligonucleotide
gguagaacugauacaugguaagaaa

SEQ ID NO: 498 - DNA, 25 bp, Artificial Sequence
  Synthetic Oligonucleotide
cagggaauacuggaaccaagaacaa

SEQ ID NO: 499 - DNA, 25 bp, Artificial Sequence
  Synthetic Oligonucleotide
ccugagcucucgauagaaguaugtg

SEQ ID NO: 500 - DNA, 25 bp, Artificial Sequence
  Synthetic Oligonucleotide
cgauagaaguaugugaagaaaaagc

SEQ ID NO: 501 - DNA, 25 bp, Artificial Sequence
  Synthetic Oligonucleotide
cuugacagcaguaacuggaaagaaa

SEQ ID NO: 502 - DNA, 25 bp, Artificial Sequence
  Synthetic Oligonucleotide
gcuaauggaccgaacugaaaugcca

SEQ ID NO: 503 - DNA, 25 bp, Artificial Sequence
  Synthetic Oligonucleotide
uuagugaggaugcuagccaagaaac

SEQ ID NO: 504 - DNA, 25 bp, Artificial Sequence
  Synthetic Oligonucleotide
gccaagaaaccuggauggaaagaaa

SEQ ID NO: 505 - DNA, 25 bp, Artificial Sequence
  Synthetic Oligonucleotide
gaaaccuggauggaaagaaacuaat

SEQ ID NO: 506 - DNA, 25 bp, Artificial Sequence
  Synthetic Oligonucleotide
gugaugcaaaugaagcuucauauag

SEQ ID NO: 507 - DNA, 25 bp, Artificial Sequence
  Synthetic Oligonucleotide
aaacgucagcucagguuguauuaga

SEQ ID NO: 508 - DNA, 25 bp, Artificial Sequence
  Synthetic Oligonucleotide
caaaagaagcuaugacagcaauagc

SEQ ID NO: 509 - DNA, 25 bp, Artificial Sequence
  Synthetic Oligonucleotide
cagcaauagccgaagccuguaugtt

SEQ ID NO: 510 - DNA, 25 bp, Artificial Sequence
  Synthetic Oligonucleotide
gaagccuguauguuaccauggactg

SEQ ID NO: 511 - DNA, 25 bp, Artificial Sequence
  Synthetic Oligonucleotide
aaaaucagucagaaacucugaautg

SEQ ID NO: 512 - DNA, 25 bp, Artificial Sequence
  Synthetic Oligonucleotide
agcuuucauuagcaaugugaagaca

SEQ ID NO: 513 - DNA, 25 bp, Artificial Sequence
  Synthetic Oligonucleotide
gagaagaugcagggacaaaguccac

SEQ ID NO: 514 - DNA, 25 bp, Artificial Sequence
  Synthetic Oligonucleotide
gcaaugaugucguugaucuuuugcc

SEQ ID NO: 515 - DNA, 25 bp, Artificial Sequence
  Synthetic Oligonucleotide
gaaguggcagguauuauuaaugacg

SEQ ID NO: 516 - DNA, 25 bp, Artificial Sequence
  Synthetic Oligonucleotide
gccuugaagggucgacucaaugatt

SEQ ID NO: 517 - DNA, 25 bp, Artificial Sequence
  Synthetic Oligonucleotide
gaagggucgacucaaugauucaaat

SEQ ID NO: 518 - DNA, 25 bp, Artificial Sequence
  Synthetic Oligonucleotide
gacucaaugauucaaauaaaauctt

SEQ ID NO: 519 - DNA, 25 bp, Artificial Sequence
  Synthetic Oligonucleotide
augauucaaauaaaaucuugguaca

SEQ ID NO: 520 - DNA, 25 bp, Artificial Sequence
  Synthetic Oligonucleotide
agccaugggcccaaauauuaagcaa

SEQ ID NO: 521 - DNA, 25 bp, Artificial Sequence
  Synthetic Oligonucleotide
aaauauuaagcaacauguaaaaaat

SEQ ID NO: 522 - DNA, 25 bp, Artificial Sequence
  Synthetic Oligonucleotide
ccuuggagacagcaagaacaaugtt

SEQ ID NO: 523 - DNA, 25 bp, Artificial Sequence
  Synthetic Oligonucleotide
gagacagcaagaacaauguucgagc

SEQ ID NO: 524 - DNA, 25 bp, Artificial Sequence
  Synthetic Oligonucleotide
caugaugcauuuaggauaugaaaaa

SEQ ID NO: 525 - DNA, 25 bp, Artificial Sequence
  Synthetic Oligonucleotide
cuagagaaagccaaaguuaacaugc

SEQ ID NO: 526 - DNA, 25 bp, Artificial Sequence
  Synthetic Oligonucleotide
gggaagaagaugccaagcaaaacca

SEQ ID NO: 527 - DNA, 25 bp, Artificial Sequence
  Synthetic Oligonucleotide
gaaaagagcaaaggaugaaagauga

SEQ ID NO: 528 - DNA, 25 bp, Artificial Sequence
  Synthetic Oligonucleotide
gagcaaaggaugaaagaugaaaaag

SEQ ID NO: 529 - DNA, 25 bp, Artificial Sequence
  Synthetic Oligonucleotide
gggaugaauacauugagcaacuaaa

SEQ ID NO: 530 - DNA, 25 bp, Artificial Sequence
  Synthetic Oligonucleotide
gaauacauugagcaacuaaagactc

SEQ ID NO: 531 - DNA, 25 bp, Artificial Sequence
  Synthetic Oligonucleotide
aguggcuuacccugagguuuuuuga

SEQ ID NO: 532 - DNA, 25 bp, Artificial Sequence
  Synthetic Oligonucleotide
ccugagguuuuuugacaccaauaca

SEQ ID NO: 533 - DNA, 25 bp, Artificial Sequence
  Synthetic Oligonucleotide
caauacaagcguccugaugaaagca

SEQ ID NO: 534 - DNA, 25 bp, Artificial Sequence
  Synthetic Oligonucleotide
guccugaugaaagcacuagaauatt

SEQ ID NO: 535 - DNA, 25 bp, Artificial Sequence
  Synthetic Oligonucleotide
augaaagcacuagaauauuuaaaat

SEQ ID NO: 536 - DNA, 25 bp, Artificial Sequence
  Synthetic Oligonucleotide
gaaaucuuucugaaaaggauaugag

SEQ ID NO: 537 - DNA, 25 bp, Artificial Sequence
  Synthetic Oligonucleotide
gaaaaggauaugagcaugcucgagg

SEQ ID NO: 538 - DNA, 25 bp, Artificial Sequence
  Synthetic Oligonucleotide
gcuccaaugccaacauguuacgcaa

SEQ ID NO: 539 - DNA, 25 bp, Artificial Sequence
  Synthetic Oligonucleotide
aaugccaacauguuacgcaagggac

SEQ ID NO: 540 - DNA, 25 bp, Artificial Sequence
  Synthetic Oligonucleotide
gugaaaugccagaacuuguucagca

SEQ ID NO: 541 - DNA, 25 bp, Artificial Sequence
  Synthetic Oligonucleotide
cagaacuuguucagcacaaacugga

SEQ ID NO: 542 - DNA, 25 bp, Artificial Sequence
  Synthetic Oligonucleotide
acaaacuggaugacauuuuugagcc

SEQ ID NO: 543 - DNA, 25 bp, Artificial Sequence
  Synthetic Oligonucleotide
gaugacauuuuugagccaguccuta

SEQ ID NO: 544 - DNA, 25 bp, Artificial Sequence
  Synthetic Oligonucleotide
cauuuuugagccaguccuuauucct

SEQ ID NO: 545 - DNA, 25 bp, Artificial Sequence
  Synthetic Oligonucleotide
gagccaguccuuauuccugaaccca

SEQ ID NO: 546 - DNA, 25 bp, Artificial Sequence
  Synthetic Oligonucleotide
cuggaguacuaaaagaccuaaugca

SEQ ID NO: 547 - DNA, 25 bp, Artificial Sequence
  Synthetic Oligonucleotide
gugaagguucuggagaagucagacc

SEQ ID NO: 548 - DNA, 25 bp, Artificial Sequence
  Synthetic Oligonucleotide
ccugagugcccuacuuguuuugctc

SEQ ID NO: 549 - DNA, 25 bp, Artificial Sequence
  Synthetic Oligonucleotide
cagccaguucucccaaauucucaga

SEQ ID NO: 550 - DNA, 25 bp, Artificial Sequence
  Synthetic Oligonucleotide
gcuuguuaugaagugucucuggaga

SEQ ID NO: 551 - DNA, 25 bp, Artificial Sequence
  Synthetic Oligonucleotide
cgacuguugccugauaccaucaata

SEQ ID NO: 552 - DNA, 25 bp, Artificial Sequence
  Synthetic Oligonucleotide
guugccugauaccaucaauagcatt

SEQ ID NO: 553 - DNA, 25 bp, Artificial Sequence
  Synthetic Oligonucleotide
cugauaccaucaauagcauuaacct

SEQ ID NO: 554 - DNA, 25 bp, Artificial Sequence
  Synthetic Oligonucleotide
aucaauagcauuaaccuagacagaa

SEQ ID NO: 555 - DNA, 25 bp, Artificial Sequence
  Synthetic Oligonucleotide
uagcauuaaccuagacagaauuctt

SEQ ID NO: 556 - DNA, 25 bp, Artificial Sequence
  Synthetic Oligonucleotide
gaauucuucuggauauccacauutt

SEQ ID NO: 557 - DNA, 25 bp, Artificial Sequence
  Synthetic Oligonucleotide
cuggauauccacauuuucaugaagg

SEQ ID NO: 558 - DNA, 25 bp, Artificial Sequence
  Synthetic Oligonucleotide
aaagagaaacugaagcaaugcaaaa

SEQ ID NO: 559 - DNA, 25 bp, Artificial Sequence
  Synthetic Oligonucleotide
gaaacugaagcaaugcaaaagugaa

SEQ ID NO: 560 - DNA, 25 bp, Artificial Sequence
  Synthetic Oligonucleotide
cggaugaugaagcacaguauggacc

SEQ ID NO: 561 - DNA, 25 bp, Artificial Sequence
  Synthetic Oligonucleotide
cagaaaagggagcaucucgaauaga

SEQ ID NO: 562 - DNA, 25 bp, Artificial Sequence
  Synthetic Oligonucleotide
agggagcaucucgaauagaugaaaa

SEQ ID NO: 563 - DNA, 25 bp, Artificial Sequence
  Synthetic Oligonucleotide
gcaucucgaauagaugaaaaaucat

SEQ ID NO: 564 - DNA, 25 bp, Artificial Sequence
  Synthetic Oligonucleotide
gagggacuagcagaguuauaugaat

SEQ ID NO: 565 - DNA, 25 bp, Artificial Sequence
  Synthetic Oligonucleotide
acucagaugcugacauugaaccatt

SEQ ID NO: 566 - DNA, 25 bp, Artificial Sequence
  Synthetic Oligonucleotide
cauucagaccuggauucuaaccaga

SEQ ID NO: 567 - DNA, 25 bp, Artificial Sequence
  Synthetic Oligonucleotide
gaccuggauucuaaccagacucact

SEQ ID NO: 568 - DNA, 25 bp, Artificial Sequence
  Synthetic Oligonucleotide
ggauucuaaccagacucacucuuca

SEQ ID NO: 569 - DNA, 25 bp, Artificial Sequence
  Synthetic Oligonucleotide
gcuaacauagacgacuugaaaaaaa

SEQ ID NO: 570 - DNA, 25 bp, Artificial Sequence
  Synthetic Oligonucleotide
cauagacgacuugaaaaaaagactg

SEQ ID NO: 571 - DNA, 25 bp, Artificial Sequence
  Synthetic Oligonucleotide
cuagaaguccucauaguuuaaaatg

SEQ ID NO: 572 - DNA, 25 bp, Artificial Sequence
  Synthetic Oligonucleotide
gaugaguuuaguguacagacuugta

SEQ ID NO: 573 - DNA, 25 bp, Artificial Sequence
  Synthetic Oligonucleotide
cagauccuuuucuuuucuuuuuaat

SEQ ID NO: 574 - DNA, 25 bp, Artificial Sequence
  Synthetic Oligonucleotide
ugcucauuuguaaaauuguccuaat

SEQ ID NO: 575 - DNA, 25 bp, Artificial Sequence
  Synthetic Oligonucleotide
gaagggucacuguauucuguaugaa

SEQ ID NO: 576 - DNA, 25 bp, Artificial Sequence
  Synthetic Oligonucleotide
gucacuguauucuguaugaaugcat

SEQ ID NO: 577 - RNA, 27 nt, Artificial Sequence
  Synthetic Oligonucleotide
ucacugucaucucccauugugcuucca

SEQ ID NO: 578 - RNA, 27 nt, Artificial Sequence
  Synthetic Oligonucleotide
acucacugucaucucccauugugcuuc

SEQ ID NO: 579 - RNA, 27 nt, Artificial Sequence
  Synthetic Oligonucleotide
ccacucacugucaucucccauugugcu

SEQ ID NO: 580 - RNA, 27 nt, Artificial Sequence
  Synthetic Oligonucleotide
aaccacucacugucaucucccauugug

SEQ ID NO: 581 - RNA, 27 nt, Artificial Sequence
  Synthetic Oligonucleotide
ucaaccacucacugucaucucccauug

SEQ ID NO: 582 - RNA, 27 nt, Artificial Sequence
  Synthetic Oligonucleotide
uuucaaccacucacugucaucucccau

SEQ ID NO: 583 - RNA, 27 nt, Artificial Sequence
  Synthetic Oligonucleotide
aguuucaaccacucacugucaucuccc

SEQ ID NO: 584 - RNA, 27 nt, Artificial Sequence
  Synthetic Oligonucleotide
gcaguuucaaccacucacugucaucuc

SEQ ID NO: 585 - RNA, 27 nt, Artificial Sequence
  Synthetic Oligonucleotide
uggcaguuucaaccacucacugucauc

SEQ ID NO: 586 - RNA, 27 nt, Artificial Sequence
  Synthetic Oligonucleotide
auccuuuauuuucuggaagaucuucag

SEQ ID NO: 587 - RNA, 27 nt, Artificial Sequence
  Synthetic Oligonucleotide
ucauccuuuauuuucuggaagaucuuc

SEQ ID NO: 588 - RNA, 27 nt, Artificial Sequence
  Synthetic Oligonucleotide
uuucauccuuuauuuucuggaagaucu

SEQ ID NO: 589 - RNA, 27 nt, Artificial Sequence
  Synthetic Oligonucleotide
cuuuucauccuuuauuuucuggaagau

SEQ ID NO: 590 - RNA, 27 nt, Artificial Sequence
  Synthetic Oligonucleotide
cucuuuucauccuuuauuuucuggaag

SEQ ID NO: 591 - RNA, 27 nt, Artificial Sequence
  Synthetic Oligonucleotide
ggcucuuuucauccuuuauuuucugga

SEQ ID NO: 592 - RNA, 27 nt, Artificial Sequence
  Synthetic Oligonucleotide
ugggcucuuuucauccuuuauuuucug

SEQ ID NO: 593 - RNA, 27 nt, Artificial Sequence
  Synthetic Oligonucleotide
ucugggcucuuuucauccuuuauuuuc

SEQ ID NO: 594 - RNA, 27 nt, Artificial Sequence
  Synthetic Oligonucleotide
uuggaaucagugacaaauuuuuugauc

SEQ ID NO: 595 - RNA, 27 nt, Artificial Sequence
  Synthetic Oligonucleotide
cauuggaaucagugacaaauuuuuuga

SEQ ID NO: 596 - RNA, 27 nt, Artificial Sequence
  Synthetic Oligonucleotide
ugcauuggaaucagugacaaauuuuuu

SEQ ID NO: 597 - RNA, 27 nt, Artificial Sequence
  Synthetic Oligonucleotide
acugcauuggaaucagugacaaauuuu

SEQ ID NO: 598 - RNA, 27 nt, Artificial Sequence
  Synthetic Oligonucleotide
ccacugcauuggaaucagugacaaauu

SEQ ID NO: 599 - RNA, 27 nt, Artificial Sequence
  Synthetic Oligonucleotide
aaccacugcauuggaaucagugacaaa

SEQ ID NO: 600 - RNA, 27 nt, Artificial Sequence
  Synthetic Oligonucleotide
ugaaccacugcauuggaaucagugaca

SEQ ID NO: 601 - RNA, 27 nt, Artificial Sequence
  Synthetic Oligonucleotide
auugaaccacugcauuggaaucaguga

SEQ ID NO: 602 - RNA, 27 nt, Artificial Sequence
  Synthetic Oligonucleotide
caauugaaccacugcauuggaaucagu

SEQ ID NO: 603 - RNA, 27 nt, Artificial Sequence
  Synthetic Oligonucleotide
uucaauugaaccacugcauuggaauca

SEQ ID NO: 604 - RNA, 27 nt, Artificial Sequence
  Synthetic Oligonucleotide
cuuucaauugaaccacugcauuggaau

SEQ ID NO: 605 - RNA, 27 nt, Artificial Sequence
  Synthetic Oligonucleotide
uccuuucaauugaaccacugcauugga

SEQ ID NO: 606 - RNA, 27 nt, Artificial Sequence
  Synthetic Oligonucleotide
aauccuuucaauugaaccacugcauug

SEQ ID NO: 607 - RNA, 27 nt, Artificial Sequence
  Synthetic Oligonucleotide
cuaauccuuucaauugaaccacugcau

SEQ ID NO: 608 - RNA, 27 nt, Artificial Sequence
  Synthetic Oligonucleotide
uucuaauccuuucaauugaaccacugc

SEQ ID NO: 609 - RNA, 27 nt, Artificial Sequence
  Synthetic Oligonucleotide
ucucuauacaggccacuaugaucuugg

SEQ ID NO: 610 - RNA, 27 nt, Artificial Sequence
  Synthetic Oligonucleotide
ugucucuauacaggccacuaugaucuu

SEQ ID NO: 611 - RNA, 27 nt, Artificial Sequence
  Synthetic Oligonucleotide
agugucucuauacaggccacuaugauc

SEQ ID NO: 612 - RNA, 27 nt, Artificial Sequence
  Synthetic Oligonucleotide
aauucacuuaaggcuuuccucaguguc

SEQ ID NO: 613 - RNA, 27 nt, Artificial Sequence
  Synthetic Oligonucleotide
caaauucacuuaaggcuuuccucagug

SEQ ID NO: 614 - RNA, 27 nt, Artificial Sequence
  Synthetic Oligonucleotide
accaaauucacuuaaggcuuuccucag

SEQ ID NO: 615 - RNA, 27 nt, Artificial Sequence
  Synthetic Oligonucleotide
gaaccaaauucacuuaaggcuuuccuc

SEQ ID NO: 616 - RNA, 27 nt, Artificial Sequence
  Synthetic Oligonucleotide
uggaaccaaauucacuuaaggcuuucc

SEQ ID NO: 617 - RNA, 27 nt, Artificial Sequence
  Synthetic Oligonucleotide
uuuggaaccaaauucacuuaaggcuuu

SEQ ID NO: 618 - RNA, 27 nt, Artificial Sequence
  Synthetic Oligonucleotide
auuuuggaaccaaauucacuuaaggcu

SEQ ID NO: 619 - RNA, 27 nt, Artificial Sequence
  Synthetic Oligonucleotide
ugauuuuggaaccaaauucacuuaagg

SEQ ID NO: 620 - RNA, 27 nt, Artificial Sequence
  Synthetic Oligonucleotide
gaugauuuuggaaccaaauucacuuaa

SEQ ID NO: 621 - RNA, 27 nt, Artificial Sequence
  Synthetic Oligonucleotide
aagaugauuuuggaaccaaauucacuu

SEQ ID NO: 622 - RNA, 27 nt, Artificial Sequence
  Synthetic Oligonucleotide
gcaagaugauuuuggaaccaaauucac

SEQ ID NO: 623 - RNA, 27 nt, Artificial Sequence
  Synthetic Oligonucleotide
aagcaagaugauuuuggaaccaaauuc

SEQ ID NO: 624 - RNA, 27 nt, Artificial Sequence
  Synthetic Oligonucleotide
uagcuucuaguucuuguugggaacgaa

SEQ ID NO: 625 - RNA, 27 nt, Artificial Sequence
  Synthetic Oligonucleotide
uuuagcuucuaguucuuguugggaacg

SEQ ID NO: 626 - RNA, 27 nt, Artificial Sequence
  Synthetic Oligonucleotide
aauuuagcuucuaguucuuguugggaa

SEQ ID NO: 627 - RNA, 27 nt, Artificial Sequence
  Synthetic Oligonucleotide
ccaauuuagcuucuaguucuuguuggg

SEQ ID NO: 628 - RNA, 27 nt, Artificial Sequence
  Synthetic Oligonucleotide
uuccaauuuagcuucuaguucuuguug

SEQ ID NO: 629 - RNA, 27 nt, Artificial Sequence
  Synthetic Oligonucleotide
ucagcaucuccaccagcagacuguugu

SEQ ID NO: 630 - RNA, 27 nt, Artificial Sequence
  Synthetic Oligonucleotide
cuucagcaucuccaccagcagacuguu

SEQ ID NO: 631 - RNA, 27 nt, Artificial Sequence
  Synthetic Oligonucleotide
ggcaccucaucaccaucaucaccaccu

SEQ ID NO: 632 - RNA, 27 nt, Artificial Sequence
  Synthetic Oligonucleotide
guggcaccucaucaccaucaucaccac

SEQ ID NO: 633 - RNA, 27 nt, Artificial Sequence
  Synthetic Oligonucleotide
agucuuugggaaguuuggaaaggauuu

SEQ ID NO: 634 - RNA, 27 nt, Artificial Sequence
  Synthetic Oligonucleotide
aaagucuuugggaaguuuggaaaggau

SEQ ID NO: 635 - RNA, 27 nt, Artificial Sequence
  Synthetic Oligonucleotide
uaaaagucuuugggaaguuuggaaagg

SEQ ID NO: 636 - RNA, 27 nt, Artificial Sequence
  Synthetic Oligonucleotide
cauaaaagucuuugggaaguuuggaaa

SEQ ID NO: 637 - RNA, 27 nt, Artificial Sequence
  Synthetic Oligonucleotide
gucauaaaagucuuugggaaguuugga

SEQ ID NO: 638 - RNA, 27 nt, Artificial Sequence
  Synthetic Oligonucleotide
uugucauaaaagucuuugggaaguuug

SEQ ID NO: 639 - RNA, 27 nt, Artificial Sequence
  Synthetic Oligonucleotide
uuuugucauaaaagucuuugggaaguu

SEQ ID NO: 640 - RNA, 27 nt, Artificial Sequence
  Synthetic Oligonucleotide
aauuuugucauaaaagucuuugggaag

SEQ ID NO: 641 - RNA, 27 nt, Artificial Sequence
  Synthetic Oligonucleotide
ucaauuuugucauaaaagucuuuggga

SEQ ID NO: 642 - RNA, 27 nt, Artificial Sequence
  Synthetic Oligonucleotide
ccucaauuuugucauaaaagucuuugg

SEQ ID NO: 643 - RNA, 27 nt, Artificial Sequence
  Synthetic Oligonucleotide
ugccucaauuuugucauaaaagucuuu

SEQ ID NO: 644 - RNA, 27 nt, Artificial Sequence
  Synthetic Oligonucleotide
uuugccucaauuuugucauaaaagucu

SEQ ID NO: 645 - RNA, 27 nt, Artificial Sequence
  Synthetic Oligonucleotide
uuuuugccucaauuuugucauaaaagu

SEQ ID NO: 646 - RNA, 27 nt, Artificial Sequence
  Synthetic Oligonucleotide
uuuuuuugccucaauuuugucauaaaa

SEQ ID NO: 647 - RNA, 27 nt, Artificial Sequence
  Synthetic Oligonucleotide
cauuuuuuugccucaauuuugucauaa

SEQ ID NO: 648 - RNA, 27 nt, Artificial Sequence
  Synthetic Oligonucleotide
agggccucuuuucucucuugccauuuu

SEQ ID NO: 649 - RNA, 27 nt, Artificial Sequence
  Synthetic Oligonucleotide
acauugguguccuuuccaacaaccuuc

SEQ ID NO: 650 - RNA, 27 nt, Artificial Sequence
  Synthetic Oligonucleotide
ugacauugguguccuuuccaacaaccu

SEQ ID NO: 651 - RNA, 27 nt, Artificial Sequence
  Synthetic Oligonucleotide
caugacauugguguccuuuccaacaac

SEQ ID NO: 652 - RNA, 27 nt, Artificial Sequence
  Synthetic Oligonucleotide
aacaugacauugguguccuuuccaaca

SEQ ID NO: 653 - RNA, 27 nt, Artificial Sequence
  Synthetic Oligonucleotide
ccaacaugacauugguguccuuuccaa

SEQ ID NO: 654 - RNA, 27 nt, Artificial Sequence
  Synthetic Oligonucleotide
caccaacaugacauugguguccuuucc

SEQ ID NO: 655 - RNA, 27 nt, Artificial Sequence
  Synthetic Oligonucleotide
gccaccaacaugacauugguguccuuu

SEQ ID NO: 656 - RNA, 27 nt, Artificial Sequence
  Synthetic Oligonucleotide
aagccaccaacaugacauugguguccu

SEQ ID NO: 657 - RNA, 27 nt, Artificial Sequence
  Synthetic Oligonucleotide
caguaagacauuuugcugccaaagcca

SEQ ID NO: 658 - RNA, 27 nt, Artificial Sequence
  Synthetic Oligonucleotide
gccaguaagacauuuugcugccaaagc

SEQ ID NO: 659 - RNA, 27 nt, Artificial Sequence
  Synthetic Oligonucleotide
aggccaguaagacauuuugcugccaaa

SEQ ID NO: 660 - RNA, 27 nt, Artificial Sequence
  Synthetic Oligonucleotide
ccaggccaguaagacauuuugcugcca

SEQ ID NO: 661 - RNA, 27 nt, Artificial Sequence
  Synthetic Oligonucleotide
agccaggccaguaagacauuuugcugc

SEQ ID NO: 662 - RNA, 27 nt, Artificial Sequence
  Synthetic Oligonucleotide
uguccugcauauuguccaaauuucuuc

SEQ ID NO: 663 - RNA, 27 nt, Artificial Sequence
  Synthetic Oligonucleotide
cauguccugcauauuguccaaauuucu

SEQ ID NO: 664 - RNA, 27 nt, Artificial Sequence
  Synthetic Oligonucleotide
aacauguccugcauauuguccaaauuu

SEQ ID NO: 665 - RNA, 27 nt, Artificial Sequence
  Synthetic Oligonucleotide
acaacauguccugcauauuguccaaau

SEQ ID NO: 666 - RNA, 27 nt, Artificial Sequence
  Synthetic Oligonucleotide
gcacaacauguccugcauauuguccaa

SEQ ID NO: 667 - RNA, 27 nt, Artificial Sequence
  Synthetic Oligonucleotide
uggcacaacauguccugcauauugucc

SEQ ID NO: 668 - RNA, 27 nt, Artificial Sequence
  Synthetic Oligonucleotide
guuggcacaacauguccugcauauugu

SEQ ID NO: 669 - RNA, 27 nt, Artificial Sequence
  Synthetic Oligonucleotide
ugguuggcacaacauguccugcauauu

SEQ ID NO: 670 - RNA, 27 nt, Artificial Sequence
  Synthetic Oligonucleotide
gaugguuggcacaacauguccugcaua

SEQ ID NO: 671 - RNA, 27 nt, Artificial Sequence
  Synthetic Oligonucleotide
aagaugguuggcacaacauguccugca

SEQ ID NO: 672 - RNA, 27 nt, Artificial Sequence
  Synthetic Oligonucleotide
uccugcagggcuuguaccacuugaggu

SEQ ID NO: 673 - RNA, 27 nt, Artificial Sequence
  Synthetic Oligonucleotide
ccuccugcagggcuuguaccacuugag

SEQ ID NO: 674 - RNA, 27 nt, Artificial Sequence
  Synthetic Oligonucleotide
ugccuccugcagggcuuguaccacuug

SEQ ID NO: 675 - RNA, 27 nt, Artificial Sequence
  Synthetic Oligonucleotide
auugccuccugcagggcuuguaccacu

SEQ ID NO: 676 - RNA, 27 nt, Artificial Sequence
  Synthetic Oligonucleotide
caauugccuccugcagggcuuguacca

SEQ ID NO: 677 - RNA, 27 nt, Artificial Sequence
  Synthetic Oligonucleotide
aucaauugccuccugcagggcuuguac

SEQ ID NO: 678 - RNA, 27 nt, Artificial Sequence
  Synthetic Oligonucleotide
gcaucaauugccuccugcagggcuugu

SEQ ID NO: 679 - RNA, 27 nt, Artificial Sequence
  Synthetic Oligonucleotide
uugcaucaauugccuccugcagggcuu

SEQ ID NO: 680 - RNA, 27 nt, Artificial Sequence
  Synthetic Oligonucleotide
gauugcaucaauugccuccugcagggc

SEQ ID NO: 681 - RNA, 27 nt, Artificial Sequence
  Synthetic Oligonucleotide
aagauugcaucaauugccuccugcagg

SEQ ID NO: 682 - RNA, 27 nt, Artificial Sequence
  Synthetic Oligonucleotide
ggaagauugcaucaauugccuccugca

SEQ ID NO: 683 - RNA, 27 nt, Artificial Sequence
  Synthetic Oligonucleotide
aaggaagauugcaucaauugccuccug

SEQ ID NO: 684 - RNA, 27 nt, Artificial Sequence
  Synthetic Oligonucleotide
guaaggaagauugcaucaauugccucc

SEQ ID NO: 685 - RNA, 27 nt, Artificial Sequence
  Synthetic Oligonucleotide
uaguaaggaagauugcaucaauugccu

SEQ ID NO: 686 - RNA, 27 nt, Artificial Sequence
  Synthetic Oligonucleotide
cacugauguucuguagugugguaguaa

SEQ ID NO: 687 - RNA, 27 nt, Artificial Sequence
  Synthetic Oligonucleotide
cucacugauguucuguagugugguagu

SEQ ID NO: 688 - RNA, 27 nt, Artificial Sequence
  Synthetic Oligonucleotide
uccucacugauguucuguaguguggua

SEQ ID NO: 689 - RNA, 27 nt, Artificial Sequence
  Synthetic Oligonucleotide
cauccucacugauguucuguagugugg

SEQ ID NO: 690 - RNA, 27 nt, Artificial Sequence
  Synthetic Oligonucleotide
aacauccucacugauguucuguagugu

SEQ ID NO: 691 - RNA, 27 nt, Artificial Sequence
  Synthetic Oligonucleotide
aaaacauccucacugauguucuguagu

SEQ ID NO: 692 - RNA, 27 nt, Artificial Sequence
  Synthetic Oligonucleotide
cuaaaacauccucacugauguucugua

SEQ ID NO: 693 - RNA, 27 nt, Artificial Sequence
  Synthetic Oligonucleotide
gauuuuuauuauccauuacugcuaaaa

SEQ ID NO: 694 - RNA, 27 nt, Artificial Sequence
  Synthetic Oligonucleotide
uggauuuuuauuauccauuacugcuaa

SEQ ID NO: 695 - RNA, 27 nt, Artificial Sequence
  Synthetic Oligonucleotide
guuggauuuuuauuauccauuacugcu

SEQ ID NO: 696 - RNA, 27 nt, Artificial Sequence
  Synthetic Oligonucleotide
ugguuggauuuuuauuauccauuacug

SEQ ID NO: 697 - RNA, 27 nt, Artificial Sequence
  Synthetic Oligonucleotide
aaagagaugucugcugcuugaugguug

SEQ ID NO: 698 - RNA, 27 nt, Artificial Sequence
  Synthetic Oligonucleotide
cagaaucauugaugugcuuaaguagug

SEQ ID NO: 699 - RNA, 27 nt, Artificial Sequence
  Synthetic Oligonucleotide
agcagaaucauugaugugcuuaaguag

SEQ ID NO: 700 - RNA, 27 nt, Artificial Sequence
  Synthetic Oligonucleotide
ggagcagaaucauugaugugcuuaagu

SEQ ID NO: 701 - RNA, 27 nt, Artificial Sequence
  Synthetic Oligonucleotide
caggagcagaaucauugaugugcuuaa

SEQ ID NO: 702 - RNA, 27 nt, Artificial Sequence
  Synthetic Oligonucleotide
uucaggagcagaaucauugaugugcuu

SEQ ID NO: 703 - RNA, 27 nt, Artificial Sequence
  Synthetic Oligonucleotide
acuucaggagcagaaucauugaugugc

SEQ ID NO: 704 - RNA, 27 nt, Artificial Sequence
  Synthetic Oligonucleotide
ugacuucaggagcagaaucauugaugu

SEQ ID NO: 705 - RNA, 27 nt, Artificial Sequence
  Synthetic Oligonucleotide
ucugacuucaggagcagaaucauugau

SEQ ID NO: 706 - RNA, 27 nt, Artificial Sequence
  Synthetic Oligonucleotide
ucucugacuucaggagcagaaucauug

SEQ ID NO: 707 - RNA, 27 nt, Artificial Sequence
  Synthetic Oligonucleotide
caucucugacuucaggagcagaaucau

SEQ ID NO: 708 - RNA, 27 nt, Artificial Sequence
  Synthetic Oligonucleotide
ggcaucucugacuucaggagcagaauc

SEQ ID NO: 709 - RNA, 27 nt, Artificial Sequence
  Synthetic Oligonucleotide
gcggcaucucugacuucaggagcagaa

SEQ ID NO: 710 - RNA, 27 nt, Artificial Sequence
  Synthetic Oligonucleotide
augcggcaucucugacuucaggagcag

SEQ ID NO: 711 - RNA, 27 nt, Artificial Sequence
  Synthetic Oligonucleotide
uaccuuuucugaacauucuuugaucuu

SEQ ID NO: 712 - RNA, 27 nt, Artificial Sequence
  Synthetic Oligonucleotide
ucuaccuuuucugaacauucuuugauc

SEQ ID NO: 713 - RNA, 27 nt, Artificial Sequence
  Synthetic Oligonucleotide
aaauuaguuucuuuccauccagguuuc

SEQ ID NO: 714 - RNA, 27 nt, Artificial Sequence
  Synthetic Oligonucleotide
gaaaauuaguuucuuuccauccagguu

SEQ ID NO: 715 - RNA, 27 nt, Artificial Sequence
  Synthetic Oligonucleotide
cugaaaauuaguuucuuuccauccagg

SEQ ID NO: 716 - RNA, 27 nt, Artificial Sequence
  Synthetic Oligonucleotide
accugaaaauuaguuucuuuccaucca

SEQ ID NO: 717 - RNA, 27 nt, Artificial Sequence
  Synthetic Oligonucleotide
ucaccugaaaauuaguuucuuuccauc

SEQ ID NO: 718 - RNA, 27 nt, Artificial Sequence
  Synthetic Oligonucleotide
caucaccugaaaauuaguuucuuucca

SEQ ID NO: 719 - RNA, 27 nt, Artificial Sequence
  Synthetic Oligonucleotide
ugcaucaccugaaaauuaguuucuuuc

SEQ ID NO: 720 - RNA, 27 nt, Artificial Sequence
  Synthetic Oligonucleotide
uuugcaucaccugaaaauuaguuucuu

SEQ ID NO: 721 - RNA, 27 nt, Artificial Sequence
  Synthetic Oligonucleotide
cauuugcaucaccugaaaauuaguuuc

SEQ ID NO: 722 - RNA, 27 nt, Artificial Sequence
  Synthetic Oligonucleotide
uucauuugcaucaccugaaaauuaguu

SEQ ID NO: 723 - RNA, 27 nt, Artificial Sequence
  Synthetic Oligonucleotide
uuucccuucugggcaaucaaagcaacu

SEQ ID NO: 724 - RNA, 27 nt, Artificial Sequence
  Synthetic Oligonucleotide
aauuucccuucugggcaaucaaagcaa

SEQ ID NO: 725 - RNA, 27 nt, Artificial Sequence
  Synthetic Oligonucleotide
aaaauuucccuucugggcaaucaaagc

SEQ ID NO: 726 - RNA, 27 nt, Artificial Sequence
  Synthetic Oligonucleotide
gaaaaauuucccuucugggcaaucaaa

SEQ ID NO: 727 - RNA, 27 nt, Artificial Sequence
  Synthetic Oligonucleotide
uggaaaaauuucccuucugggcaauca

SEQ ID NO: 728 - RNA, 27 nt, Artificial Sequence
  Synthetic Oligonucleotide
uuuggaaaaauuucccuucugggcaau

SEQ ID NO: 729 - RNA, 27 nt, Artificial Sequence
  Synthetic Oligonucleotide
guuuuggaaaaauuucccuucugggca

SEQ ID NO: 730 - RNA, 27 nt, Artificial Sequence
  Synthetic Oligonucleotide
cacauuucacaucuccaaucuugucca

SEQ ID NO: 731 - RNA, 27 nt, Artificial Sequence
  Synthetic Oligonucleotide
cccacauuucacaucuccaaucuuguc

SEQ ID NO: 732 - RNA, 27 nt, Artificial Sequence
  Synthetic Oligonucleotide
uucccacauuucacaucuccaaucuug

SEQ ID NO: 733 - RNA, 27 nt, Artificial Sequence
  Synthetic Oligonucleotide
uguucccacauuucacaucuccaaucu

SEQ ID NO: 734 - RNA, 27 nt, Artificial Sequence
  Synthetic Oligonucleotide
auuguucccacauuucacaucuccaau

SEQ ID NO: 735 - RNA, 27 nt, Artificial Sequence
  Synthetic Oligonucleotide
gcauuguucccacauuucacaucucca

SEQ ID NO: 736 - RNA, 27 nt, Artificial Sequence
  Synthetic Oligonucleotide
uugcauuguucccacauuucacaucuc

SEQ ID NO: 737 - RNA, 27 nt, Artificial Sequence
  Synthetic Oligonucleotide
uuuugcauuguucccacauuucacauc

SEQ ID NO: 738 - RNA, 27 nt, Artificial Sequence
  Synthetic Oligonucleotide
ucuuuugcauuguucccacauuucaca

SEQ ID NO: 739 - RNA, 27 nt, Artificial Sequence
  Synthetic Oligonucleotide
cuucuuuugcauuguucccacauuuca

SEQ ID NO: 740 - RNA, 27 nt, Artificial Sequence
  Synthetic Oligonucleotide
agcuucuuuugcauuguucccacauuu

SEQ ID NO: 741 - RNA, 27 nt, Artificial Sequence
  Synthetic Oligonucleotide
auagcuucuuuugcauuguucccacau

SEQ ID NO: 742 - RNA, 27 nt, Artificial Sequence
  Synthetic Oligonucleotide
ucauagcuucuuuugcauuguucccac

SEQ ID NO: 743 - RNA, 27 nt, Artificial Sequence
  Synthetic Oligonucleotide
gcuaaugaaagcuuugacauucaaccc

SEQ ID NO: 744 - RNA, 27 nt, Artificial Sequence
  Synthetic Oligonucleotide
uugcuaaugaaagcuuugacauucaac

SEQ ID NO: 745 - RNA, 27 nt, Artificial Sequence
  Synthetic Oligonucleotide
cauugcuaaugaaagcuuugacauuca

SEQ ID NO: 746 - RNA, 27 nt, Artificial Sequence
  Synthetic Oligonucleotide
cacauugcuaaugaaagcuuugacauu

SEQ ID NO: 747 - RNA, 27 nt, Artificial Sequence
  Synthetic Oligonucleotide
uucacauugcuaaugaaagcuuugaca

SEQ ID NO: 748 - RNA, 27 nt, Artificial Sequence
  Synthetic Oligonucleotide
uacagauacaucacgccaagcaggguu

SEQ ID NO: 749 - RNA, 27 nt, Artificial Sequence
  Synthetic Oligonucleotide
cauacagauacaucacgccaagcaggg

SEQ ID NO: 750 - RNA, 27 nt, Artificial Sequence
  Synthetic Oligonucleotide
agggcaggcuucucauccucaaagaac

SEQ ID NO: 751 - RNA, 27 nt, Artificial Sequence
  Synthetic Oligonucleotide
ggagggcaggcuucucauccucaaaga

SEQ ID NO: 752 - RNA, 27 nt, Artificial Sequence
  Synthetic Oligonucleotide
uaggagggcaggcuucucauccucaaa

SEQ ID NO: 753 - RNA, 27 nt, Artificial Sequence
  Synthetic Oligonucleotide
gauaggagggcaggcuucucauccuca

SEQ ID NO: 754 - RNA, 27 nt, Artificial Sequence
  Synthetic Oligonucleotide
gggauaggagggcaggcuucucauccu

SEQ ID NO: 755 - RNA, 27 nt, Artificial Sequence
  Synthetic Oligonucleotide
cugggauaggagggcaggcuucucauc

SEQ ID NO: 756 - RNA, 27 nt, Artificial Sequence
  Synthetic Oligonucleotide
aucugggauaggagggcaggcuucuca

SEQ ID NO: 757 - RNA, 27 nt, Artificial Sequence
  Synthetic Oligonucleotide
cuaucugggauaggagggcaggcuucu

SEQ ID NO: 758 - RNA, 27 nt, Artificial Sequence
  Synthetic Oligonucleotide
aucuaucugggauaggagggcaggcuu

SEQ ID NO: 759 - RNA, 27 nt, Artificial Sequence
  Synthetic Oligonucleotide
gcaucuaucugggauaggagggcaggc

SEQ ID NO: 760 - RNA, 27 nt, Artificial Sequence
  Synthetic Oligonucleotide
cugcaucuaucugggauaggagggcag

SEQ ID NO: 761 - RNA, 27 nt, Artificial Sequence
  Synthetic Oligonucleotide
uucugcaucuaucugggauaggagggc

SEQ ID NO: 762 - RNA, 27 nt, Artificial Sequence
  Synthetic Oligonucleotide
aauucugcaucuaucugggauaggagg

SEQ ID NO: 763 - RNA, 27 nt, Artificial Sequence
  Synthetic Oligonucleotide
caaauucugcaucuaucugggauagga

SEQ ID NO: 764 - RNA, 27 nt, Artificial Sequence
  Synthetic Oligonucleotide
cucaaauucugcaucuaucugggauag

SEQ ID NO: 765 - RNA, 27 nt, Artificial Sequence
  Synthetic Oligonucleotide
uucucaaauucugcaucuaucugggau

SEQ ID NO: 766 - RNA, 27 nt, Artificial Sequence
  Synthetic Oligonucleotide
cagguggacuuugucccugcaucuucu

SEQ ID NO: 767 - RNA, 27 nt, Artificial Sequence
  Synthetic Oligonucleotide
aucuccaucuucuccuucaucuguacc

SEQ ID NO: 768 - RNA, 27 nt, Artificial Sequence
  Synthetic Oligonucleotide
ucaucuccaucuucuccuucaucugua

SEQ ID NO: 769 - RNA, 27 nt, Artificial Sequence
  Synthetic Oligonucleotide
guucaucuccaucuucuccuucaucug

SEQ ID NO: 770 - RNA, 27 nt, Artificial Sequence
  Synthetic Oligonucleotide
ucuccguccucggcaaaagaucaacga

SEQ ID NO: 771 - RNA, 27 nt, Artificial Sequence
  Synthetic Oligonucleotide
gccacuucaucuaggccuucuuuccua

SEQ ID NO: 772 - RNA, 27 nt, Artificial Sequence
  Synthetic Oligonucleotide
cugccacuucaucuaggccuucuuucc

SEQ ID NO: 773 - RNA, 27 nt, Artificial Sequence
  Synthetic Oligonucleotide
accugccacuucaucuaggccuucuuu

SEQ ID NO: 774 - RNA, 27 nt, Artificial Sequence
  Synthetic Oligonucleotide
auaccugccacuucaucuaggccuucu

SEQ ID NO: 775 - RNA, 27 nt, Artificial Sequence
  Synthetic Oligonucleotide
uaauaccugccacuucaucuaggccuu

SEQ ID NO: 776 - RNA, 27 nt, Artificial Sequence
  Synthetic Oligonucleotide
aauaauaccugccacuucaucuaggcc

SEQ ID NO: 777 - RNA, 27 nt, Artificial Sequence
  Synthetic Oligonucleotide
uuaauaauaccugccacuucaucuagg

SEQ ID NO: 778 - RNA, 27 nt, Artificial Sequence
  Synthetic Oligonucleotide
cauuaauaauaccugccacuucaucua

SEQ ID NO: 779 - RNA, 27 nt, Artificial Sequence
  Synthetic Oligonucleotide
aggcaguuggaaguucaccuauauucg

SEQ ID NO: 780 - RNA, 27 nt, Artificial Sequence
  Synthetic Oligonucleotide
caaggcaguuggaaguucaccuauauu

SEQ ID NO: 781 - RNA, 27 nt, Artificial Sequence
  Synthetic Oligonucleotide
uucaaggcaguuggaaguucaccuaua

SEQ ID NO: 782 - RNA, 27 nt, Artificial Sequence
  Synthetic Oligonucleotide
ccuucaaggcaguuggaaguucaccua

SEQ ID NO: 783 - RNA, 27 nt, Artificial Sequence
  Synthetic Oligonucleotide
acccuucaaggcaguuggaaguucacc

SEQ ID NO: 784 - RNA, 27 nt, Artificial Sequence
  Synthetic Oligonucleotide
cgacccuucaaggcaguuggaaguuca

SEQ ID NO: 785 - RNA, 27 nt, Artificial Sequence
  Synthetic Oligonucleotide
gucgacccuucaaggcaguuggaaguu

SEQ ID NO: 786 - RNA, 27 nt, Artificial Sequence
  Synthetic Oligonucleotide
gagucgacccuucaaggcaguuggaag

SEQ ID NO: 787 - RNA, 27 nt, Artificial Sequence
  Synthetic Oligonucleotide
uugagucgacccuucaaggcaguugga

SEQ ID NO: 788 - RNA, 27 nt, Artificial Sequence
  Synthetic Oligonucleotide
cauugagucgacccuucaaggcaguug

SEQ ID NO: 789 - RNA, 27 nt, Artificial Sequence
  Synthetic Oligonucleotide
uugggcccauggcuacugccaguuguu

SEQ ID NO: 790 - RNA, 27 nt, Artificial Sequence
  Synthetic Oligonucleotide
cagcagcucgaacauuguucuugcugu

SEQ ID NO: 791 - RNA, 27 nt, Artificial Sequence
  Synthetic Oligonucleotide
ggcagcagcucgaacauuguucuugcu

SEQ ID NO: 792 - RNA, 27 nt, Artificial Sequence
  Synthetic Oligonucleotide
agggcagcagcucgaacauuguucuug

SEQ ID NO: 793 - RNA, 27 nt, Artificial Sequence
  Synthetic Oligonucleotide
cuagggcagcagcucgaacauuguucu

SEQ ID NO: 794 - RNA, 27 nt, Artificial Sequence
  Synthetic Oligonucleotide
cgcuagggcagcagcucgaacauuguu

SEQ ID NO: 795 - RNA, 27 nt, Artificial Sequence
  Synthetic Oligonucleotide
gucgcuagggcagcagcucgaacauug

SEQ ID NO: 796 - RNA, 27 nt, Artificial Sequence
  Synthetic Oligonucleotide
cagucgcuagggcagcagcucgaacau

SEQ ID NO: 797 - RNA, 27 nt, Artificial Sequence
  Synthetic Oligonucleotide
ucuguucugcccaagcauucacagucg

SEQ ID NO: 798 - RNA, 27 nt, Artificial Sequence
  Synthetic Oligonucleotide
agucuguucugcccaagcauucacagu

SEQ ID NO: 799 - RNA, 27 nt, Artificial Sequence
  Synthetic Oligonucleotide
ccagucuguucugcccaagcauucaca

SEQ ID NO: 800 - RNA, 27 nt, Artificial Sequence
  Synthetic Oligonucleotide
uugagcucuucagaaagaucuucuccu

SEQ ID NO: 801 - RNA, 27 nt, Artificial Sequence
  Synthetic Oligonucleotide
gcacaucuccauuucgaucuucuaggc

SEQ ID NO: 802 - RNA, 27 nt, Artificial Sequence
  Synthetic Oligonucleotide
ucgcacaucuccauuucgaucuucuag

SEQ ID NO: 803 - RNA, 27 nt, Artificial Sequence
  Synthetic Oligonucleotide
uuucgcacaucuccauuucgaucuucu

SEQ ID NO: 804 - RNA, 27 nt, Artificial Sequence
  Synthetic Oligonucleotide
auuuuuucauauccuaaaugcaucaug

SEQ ID NO: 805 - RNA, 27 nt, Artificial Sequence
  Synthetic Oligonucleotide
ccauuuuuucauauccuaaaugcauca

SEQ ID NO: 806 - RNA, 27 nt, Artificial Sequence
  Synthetic Oligonucleotide
ggccauuuuuucauauccuaaaugcau

SEQ ID NO: 807 - RNA, 27 nt, Artificial Sequence
  Synthetic Oligonucleotide
uuggccauuuuuucauauccuaaaugc

SEQ ID NO: 808 - RNA, 27 nt, Artificial Sequence
  Synthetic Oligonucleotide
ccuuggccauuuuuucauauccuaaau

SEQ ID NO: 809 - RNA, 27 nt, Artificial Sequence
  Synthetic Oligonucleotide
uuggcuuuaguuucccaguagccuugg

SEQ ID NO: 810 - RNA, 27 nt, Artificial Sequence
  Synthetic Oligonucleotide
aguuggcuuuaguuucccaguagccuu

SEQ ID NO: 811 - RNA, 27 nt, Artificial Sequence
  Synthetic Oligonucleotide
gaaguuggcuuuaguuucccaguagcc

SEQ ID NO: 812 - RNA, 27 nt, Artificial Sequence
  Synthetic Oligonucleotide
uagaaguuggcuuuaguuucccaguag

SEQ ID NO: 813 - RNA, 27 nt, Artificial Sequence
  Synthetic Oligonucleotide
uuuagaaguuggcuuuaguuucccagu

SEQ ID NO: 814 - RNA, 27 nt, Artificial Sequence
  Synthetic Oligonucleotide
ucuuuagaaguuggcuuuaguuuccca

SEQ ID NO: 815 - RNA, 27 nt, Artificial Sequence
  Synthetic Oligonucleotide
gaucuuuagaaguuggcuuuaguuucc

SEQ ID NO: 816 - RNA, 27 nt, Artificial Sequence
  Synthetic Oligonucleotide
cugaucuuuagaaguuggcuuuaguuu

SEQ ID NO: 817 - RNA, 27 nt, Artificial Sequence
  Synthetic Oligonucleotide
accugaucuuuagaaguuggcuuuagu

SEQ ID NO: 818 - RNA, 27 nt, Artificial Sequence
  Synthetic Oligonucleotide
auaccugaucuuuagaaguuggcuuua

SEQ ID NO: 819 - RNA, 27 nt, Artificial Sequence
  Synthetic Oligonucleotide
cauuuggaacaacaauaaaaauaggcc

SEQ ID NO: 820 - RNA, 27 nt, Artificial Sequence
  Synthetic Oligonucleotide
uccauuuggaacaacaauaaaaauagg

SEQ ID NO: 821 - RNA, 27 nt, Artificial Sequence
  Synthetic Oligonucleotide
uuuccauuuggaacaacaauaaaaaua

SEQ ID NO: 822 - RNA, 27 nt, Artificial Sequence
  Synthetic Oligonucleotide
cuuuuccauuuggaacaacaauaaaaa

SEQ ID NO: 823 - RNA, 27 nt, Artificial Sequence
  Synthetic Oligonucleotide
cucuuuuccauuuggaacaacaauaaa

SEQ ID NO: 824 - RNA, 27 nt, Artificial Sequence
  Synthetic Oligonucleotide
ugcucuuuuccauuuggaacaacaaua

SEQ ID NO: 825 - RNA, 27 nt, Artificial Sequence
  Synthetic Oligonucleotide
guaguaaaauuccacuuuagcaccuuc

SEQ ID NO: 826 - RNA, 27 nt, Artificial Sequence
  Synthetic Oligonucleotide
ggguaguaaaauuccacuuuagcaccu

SEQ ID NO: 827 - RNA, 27 nt, Artificial Sequence
  Synthetic Oligonucleotide
gaugcuucauucucaguaagaugauau

SEQ ID NO: 828 - RNA, 27 nt, Artificial Sequence
  Synthetic Oligonucleotide
aagaugcuucauucucaguaagaugau

SEQ ID NO: 829 - RNA, 27 nt, Artificial Sequence
  Synthetic Oligonucleotide
ggaagaugcuucauucucaguaagaug

SEQ ID NO: 830 - RNA, 27 nt, Artificial Sequence
  Synthetic Oligonucleotide
aaggaagaugcuucauucucaguaaga

SEQ ID NO: 831 - RNA, 27 nt, Artificial Sequence
  Synthetic Oligonucleotide
gacauccuuugguucuccaaccuugac

SEQ ID NO: 832 - RNA, 27 nt, Artificial Sequence
  Synthetic Oligonucleotide
augacauccuuugguucuccaaccuug

SEQ ID NO: 833 - RNA, 27 nt, Artificial Sequence
  Synthetic Oligonucleotide
gaaugacauccuuugguucuccaaccu

SEQ ID NO: 834 - RNA, 27 nt, Artificial Sequence
  Synthetic Oligonucleotide
acgaaugacauccuuugguucuccaac

SEQ ID NO: 835 - RNA, 27 nt, Artificial Sequence
  Synthetic Oligonucleotide
uuacgaaugacauccuuugguucucca

SEQ ID NO: 836 - RNA, 27 nt, Artificial Sequence
  Synthetic Oligonucleotide
cuuuacgaaugacauccuuugguucuc

SEQ ID NO: 837 - RNA, 27 nt, Artificial Sequence
  Synthetic Oligonucleotide
aucuuuacgaaugacauccuuugguuc

SEQ ID NO: 838 - RNA, 27 nt, Artificial Sequence
  Synthetic Oligonucleotide
acaucuuuacgaaugacauccuuuggu

SEQ ID NO: 839 - RNA, 27 nt, Artificial Sequence
  Synthetic Oligonucleotide
gaacaucuuuacgaaugacauccuuug

SEQ ID NO: 840 - RNA, 27 nt, Artificial Sequence
  Synthetic Oligonucleotide
acgaacaucuuuacgaaugacauccuu

SEQ ID NO: 841 - RNA, 27 nt, Artificial Sequence
  Synthetic Oligonucleotide
gcacgaacaucuuuacgaaugacaucc

SEQ ID NO: 842 - RNA, 27 nt, Artificial Sequence
  Synthetic Oligonucleotide
uagacaaggcacauccgguucaggaug

SEQ ID NO: 843 - RNA, 27 nt, Artificial Sequence
  Synthetic Oligonucleotide
gguagacaaggcacauccgguucagga

SEQ ID NO: 844 - RNA, 27 nt, Artificial Sequence
  Synthetic Oligonucleotide
uggguagacaaggcacauccgguucag

SEQ ID NO: 845 - RNA, 27 nt, Artificial Sequence
  Synthetic Oligonucleotide
gcuggguagacaaggcacauccgguuc

SEQ ID NO: 846 - RNA, 27 nt, Artificial Sequence
  Synthetic Oligonucleotide
uagcuggguagacaaggcacauccggu

SEQ ID NO: 847 - RNA, 27 nt, Artificial Sequence
  Synthetic Oligonucleotide
gcuagcuggguagacaaggcacauccg

SEQ ID NO: 848 - RNA, 27 nt, Artificial Sequence
  Synthetic Oligonucleotide
uugcuagcuggguagacaaggcacauc

SEQ ID NO: 849 - RNA, 27 nt, Artificial Sequence
  Synthetic Oligonucleotide
ucugcucucugcuuagaguuuuuggau

SEQ ID NO: 850 - RNA, 27 nt, Artificial Sequence
  Synthetic Oligonucleotide
acucugcucucugcuuagaguuuuugg

SEQ ID NO: 851 - RNA, 27 nt, Artificial Sequence
  Synthetic Oligonucleotide
gcacucugcucucugcuuagaguuuuu

SEQ ID NO: 852 - RNA, 27 nt, Artificial Sequence
  Synthetic Oligonucleotide
aggcacucugcucucugcuuagaguuu

SEQ ID NO: 853 - RNA, 27 nt, Artificial Sequence
  Synthetic Oligonucleotide
ccaggcacucugcucucugcuuagagu

SEQ ID NO: 854 - RNA, 27 nt, Artificial Sequence
  Synthetic Oligonucleotide
uuccaggcacucugcucucugcuuaga

SEQ ID NO: 855 - RNA, 27 nt, Artificial Sequence
  Synthetic Oligonucleotide
ucuuccaggcacucugcucucugcuua

SEQ ID NO: 856 - RNA, 27 nt, Artificial Sequence
  Synthetic Oligonucleotide
gcucuuccaggcacucugcucucugcu

SEQ ID NO: 857 - RNA, 27 nt, Artificial Sequence
  Synthetic Oligonucleotide
cagcucuuccaggcacucugcucucug

SEQ ID NO: 858 - RNA, 27 nt, Artificial Sequence
  Synthetic Oligonucleotide
cccagcucuuccaggcacucugcucuc

SEQ ID NO: 859 - RNA, 27 nt, Artificial Sequence
  Synthetic Oligonucleotide
aucccagcucuuccaggcacucugcuc

SEQ ID NO: 860 - RNA, 27 nt, Artificial Sequence
  Synthetic Oligonucleotide
gcuauuuccuuuaaggcuuuuccuggg

SEQ ID NO: 861 - RNA, 27 nt, Artificial Sequence
  Synthetic Oligonucleotide
uuuccaaucaguuugaacaccugaucc

SEQ ID NO: 862 - RNA, 27 nt, Artificial Sequence
  Synthetic Oligonucleotide
gauuuccaaucaguuugaacaccugau

SEQ ID NO: 863 - RNA, 27 nt, Artificial Sequence
  Synthetic Oligonucleotide
aagauuuccaaucaguuugaacaccug

SEQ ID NO: 864 - RNA, 27 nt, Artificial Sequence
  Synthetic Oligonucleotide
gaaagauuuccaaucaguuugaacacc

SEQ ID NO: 865 - RNA, 27 nt, Artificial Sequence
  Synthetic Oligonucleotide
cagaaagauuuccaaucaguuugaaca

SEQ ID NO: 866 - RNA, 27 nt, Artificial Sequence
  Synthetic Oligonucleotide
uucagaaagauuuccaaucaguuugaa

SEQ ID NO: 867 - RNA, 27 nt, Artificial Sequence
  Synthetic Oligonucleotide
uuuucagaaagauuuccaaucaguuug

SEQ ID NO: 868 - RNA, 27 nt, Artificial Sequence
  Synthetic Oligonucleotide
ccuuuucagaaagauuuccaaucaguu

SEQ ID NO: 869 - RNA, 27 nt, Artificial Sequence
  Synthetic Oligonucleotide
cagagggucucuuugcugaccgcuuaa

SEQ ID NO: 870 - RNA, 27 nt, Artificial Sequence
  Synthetic Oligonucleotide
agcagagggucucuuugcugaccgcuu

SEQ ID NO: 871 - RNA, 27 nt, Artificial Sequence
  Synthetic Oligonucleotide
gcagcagagggucucuuugcugaccgc

SEQ ID NO: 872 - RNA, 27 nt, Artificial Sequence
  Synthetic Oligonucleotide
gugcagcagagggucucuuugcugacc

SEQ ID NO: 873 - RNA, 27 nt, Artificial Sequence
  Synthetic Oligonucleotide
uggugcagcagagggucucuuugcuga

SEQ ID NO: 874 - RNA, 27 nt, Artificial Sequence
  Synthetic Oligonucleotide
auuggugcagcagagggucucuuugcu

SEQ ID NO: 875 - RNA, 27 nt, Artificial Sequence
  Synthetic Oligonucleotide
uuauuggugcagcagagggucucuuug

SEQ ID NO: 876 - RNA, 27 nt, Artificial Sequence
  Synthetic Oligonucleotide
auguccucagcuggucccuugcguaac

SEQ ID NO: 877 - RNA, 27 nt, Artificial Sequence
  Synthetic Oligonucleotide
acauguccucagcuggucccuugcgua

SEQ ID NO: 878 - RNA, 27 nt, Artificial Sequence
  Synthetic Oligonucleotide
cuagauccagcuggaauucucggcgga

SEQ ID NO: 879 - RNA, 27 nt, Artificial Sequence
  Synthetic Oligonucleotide
aucuagauccagcuggaauucucggcg

SEQ ID NO: 880 - RNA, 27 nt, Artificial Sequence
  Synthetic Oligonucleotide
aaguguggagaaacagcccggaucuug

SEQ ID NO: 881 - RNA, 27 nt, Artificial Sequence
  Synthetic Oligonucleotide
cgaaguguggagaaacagcccggaucu

SEQ ID NO: 882 - RNA, 27 nt, Artificial Sequence
  Synthetic Oligonucleotide
augcuguauuacugugcaugucaucga

SEQ ID NO: 883 - RNA, 27 nt, Artificial Sequence
  Synthetic Oligonucleotide
ggaugcuguauuacugugcaugucauc

SEQ ID NO: 884 - RNA, 27 nt, Artificial Sequence
  Synthetic Oligonucleotide
guggaugcuguauuacugugcauguca

SEQ ID NO: 885 - RNA, 27 nt, Artificial Sequence
  Synthetic Oligonucleotide
uuguggaugcuguauuacugugcaugu

SEQ ID NO: 886 - RNA, 27 nt, Artificial Sequence
  Synthetic Oligonucleotide
gauuguggaugcuguauuacugugcau

SEQ ID NO: 887 - RNA, 27 nt, Artificial Sequence
  Synthetic Oligonucleotide
uugauuguggaugcuguauuacugugc

SEQ ID NO: 888 - RNA, 27 nt, Artificial Sequence
  Synthetic Oligonucleotide
aauugauuguggaugcuguauuacugu

SEQ ID NO: 889 - RNA, 27 nt, Artificial Sequence
  Synthetic Oligonucleotide
gaaauugauuguggaugcuguauuacu

SEQ ID NO: 890 - RNA, 27 nt, Artificial Sequence
  Synthetic Oligonucleotide
augaaauugauuguggaugcuguauua

SEQ ID NO: 891 - RNA, 27 nt, Artificial Sequence
  Synthetic Oligonucleotide
uaaugaaauugauuguggaugcuguau

SEQ ID NO: 892 - RNA, 27 nt, Artificial Sequence
  Synthetic Oligonucleotide
gauaaugaaauugauuguggaugcugu

SEQ ID NO: 893 - RNA, 27 nt, Artificial Sequence
  Synthetic Oligonucleotide
gagauaaugaaauugauuguggaugcu

SEQ ID NO: 894 - RNA, 27 nt, Artificial Sequence
  Synthetic Oligonucleotide
gggagauaaugaaauugauuguggaug

SEQ ID NO: 895 - RNA, 27 nt, Artificial Sequence
  Synthetic Oligonucleotide
uugggagauaaugaaauugauugugga

SEQ ID NO: 896 - RNA, 27 nt, Artificial Sequence
  Synthetic Oligonucleotide
acuugggagauaaugaaauugauugug

SEQ ID NO: 897 - RNA, 27 nt, Artificial Sequence
  Synthetic Oligonucleotide
cuacuugggagauaaugaaauugauug

SEQ ID NO: 898 - RNA, 27 nt, Artificial Sequence
  Synthetic Oligonucleotide
ggcuacuugggagauaaugaaauugau

SEQ ID NO: 899 - RNA, 27 nt, Artificial Sequence
  Synthetic Oligonucleotide
cuggcuacuugggagauaaugaaauug

SEQ ID NO: 900 - RNA, 27 nt, Artificial Sequence
  Synthetic Oligonucleotide
cacuggcuacuugggagauaaugaaau

SEQ ID NO: 901 - RNA, 27 nt, Artificial Sequence
  Synthetic Oligonucleotide
accacuggcuacuugggagauaaugaa

SEQ ID NO: 902 - RNA, 27 nt, Artificial Sequence
  Synthetic Oligonucleotide
ucaccacuggcuacuugggagauaaug

SEQ ID NO: 903 - RNA, 27 nt, Artificial Sequence
  Synthetic Oligonucleotide
ugucaccacuggcuacuugggagauaa

SEQ ID NO: 904 - RNA, 27 nt, Artificial Sequence
  Synthetic Oligonucleotide
gaugucaccacuggcuacuugggagau

SEQ ID NO: 905 - RNA, 27 nt, Artificial Sequence
  Synthetic Oligonucleotide
uugaugucaccacuggcuacuugggag

SEQ ID NO: 906 - RNA, 27 nt, Artificial Sequence
  Synthetic Oligonucleotide
uguugaugucaccacuggcuacuuggg

SEQ ID NO: 907 - RNA, 27 nt, Artificial Sequence
  Synthetic Oligonucleotide
guacuccaguggaggccucccgggcaa

SEQ ID NO: 908 - RNA, 27 nt, Artificial Sequence
  Synthetic Oligonucleotide
uaguacuccaguggaggccucccgggc

SEQ ID NO: 909 - RNA, 27 nt, Artificial Sequence
  Synthetic Oligonucleotide
uuuaguacuccaguggaggccucccgg

SEQ ID NO: 910 - RNA, 27 nt, Artificial Sequence
  Synthetic Oligonucleotide
cuuuuaguacuccaguggaggccuccc

SEQ ID NO: 911 - RNA, 27 nt, Artificial Sequence
  Synthetic Oligonucleotide
uccgagaauccagcauuaaggugauga

SEQ ID NO: 912 - RNA, 27 nt, Artificial Sequence
  Synthetic Oligonucleotide
aauccgagaauccagcauuaaggugau

SEQ ID NO: 913 - RNA, 27 nt, Artificial Sequence
  Synthetic Oligonucleotide
ucaauccgagaauccagcauuaaggug

SEQ ID NO: 914 - RNA, 27 nt, Artificial Sequence
  Synthetic Oligonucleotide
cuucaauccgagaauccagcauuaagg

SEQ ID NO: 915 - RNA, 27 nt, Artificial Sequence
  Synthetic Oligonucleotide
aucuucaauccgagaauccagcauuaa

SEQ ID NO: 916 - RNA, 27 nt, Artificial Sequence
  Synthetic Oligonucleotide
agaucuucaauccgagaauccagcauu

SEQ ID NO: 917 - RNA, 27 nt, Artificial Sequence
  Synthetic Oligonucleotide
caagaucuucaauccgagaauccagca

SEQ ID NO: 918 - RNA, 27 nt, Artificial Sequence
  Synthetic Oligonucleotide
cucaagaucuucaauccgagaauccag

SEQ ID NO: 919 - RNA, 27 nt, Artificial Sequence
  Synthetic Oligonucleotide
uccucaagaucuucaauccgagaaucc

SEQ ID NO: 920 - RNA, 27 nt, Artificial Sequence
  Synthetic Oligonucleotide
accuucaccaccaagagguucacagag

SEQ ID NO: 921 - RNA, 27 nt, Artificial Sequence
  Synthetic Oligonucleotide
gaaccuucaccaccaagagguucacag

SEQ ID NO: 922 - RNA, 27 nt, Artificial Sequence
  Synthetic Oligonucleotide
cagaaccuucaccaccaagagguucac

SEQ ID NO: 923 - RNA, 27 nt, Artificial Sequence
  Synthetic Oligonucleotide
uccagaaccuucaccaccaagagguuc

SEQ ID NO: 924 - RNA, 27 nt, Artificial Sequence
  Synthetic Oligonucleotide
aacuggcuguugcuagcaggcugucuu

SEQ ID NO: 925 - RNA, 27 nt, Artificial Sequence
  Synthetic Oligonucleotide
caagcucugagaauuugggagaacugg

SEQ ID NO: 926 - RNA, 27 nt, Artificial Sequence
  Synthetic Oligonucleotide
aacaagcucugagaauuugggagaacu

SEQ ID NO: 927 - RNA, 27 nt, Artificial Sequence
  Synthetic Oligonucleotide
auaacaagcucugagaauuugggagaa

SEQ ID NO: 928 - RNA, 27 nt, Artificial Sequence
  Synthetic Oligonucleotide
ucauaacaagcucugagaauuugggag

SEQ ID NO: 929 - RNA, 27 nt, Artificial Sequence
  Synthetic Oligonucleotide
cuucauaacaagcucugagaauuuggg

SEQ ID NO: 930 - RNA, 27 nt, Artificial Sequence
  Synthetic Oligonucleotide
cacuucauaacaagcucugagaauuug

SEQ ID NO: 931 - RNA, 27 nt, Artificial Sequence
  Synthetic Oligonucleotide
gacacuucauaacaagcucugagaauu

SEQ ID NO: 932 - RNA, 27 nt, Artificial Sequence
  Synthetic Oligonucleotide
gagacacuucauaacaagcucugagaa

SEQ ID NO: 933 - RNA, 27 nt, Artificial Sequence
  Synthetic Oligonucleotide
cagagacacuucauaacaagcucugag

SEQ ID NO: 934 - RNA, 27 nt, Artificial Sequence
  Synthetic Oligonucleotide
uccagagacacuucauaacaagcucug

SEQ ID NO: 935 - RNA, 27 nt, Artificial Sequence
  Synthetic Oligonucleotide
gaagaauucugucuagguuaaugcuau

SEQ ID NO: 936 - RNA, 27 nt, Artificial Sequence
  Synthetic Oligonucleotide
cagaagaauucugucuagguuaaugcu

SEQ ID NO: 937 - RNA, 27 nt, Artificial Sequence
  Synthetic Oligonucleotide
uccagaagaauucugucuagguuaaug

SEQ ID NO: 938 - RNA, 27 nt, Artificial Sequence
  Synthetic Oligonucleotide
uauccagaagaauucugucuagguuaa

SEQ ID NO: 939 - RNA, 27 nt, Artificial Sequence
  Synthetic Oligonucleotide
gauauccagaagaauucugucuagguu

SEQ ID NO: 940 - RNA, 27 nt, Artificial Sequence
  Synthetic Oligonucleotide
uggauauccagaagaauucugucuagg

SEQ ID NO: 941 - RNA, 27 nt, Artificial Sequence
  Synthetic Oligonucleotide
gggaagaccuucaugaaaauguggaua

SEQ ID NO: 942 - RNA, 27 nt, Artificial Sequence
  Synthetic Oligonucleotide
gggaaauucacuuuugcauugcuucag

SEQ ID NO: 943 - RNA, 27 nt, Artificial Sequence
  Synthetic Oligonucleotide
augggaaauucacuuuugcauugcuuc

SEQ ID NO: 944 - RNA, 27 nt, Artificial Sequence
  Synthetic Oligonucleotide
uuaugggaaauucacuuuugcauugcu

SEQ ID NO: 945 - RNA, 27 nt, Artificial Sequence
  Synthetic Oligonucleotide
acuugcucccagucugguccauacugu

SEQ ID NO: 946 - RNA, 27 nt, Artificial Sequence
  Synthetic Oligonucleotide
agacuugcucccagucugguccauacu

SEQ ID NO: 947 - RNA, 27 nt, Artificial Sequence
  Synthetic Oligonucleotide
ucagacuugcucccagucugguccaua

SEQ ID NO: 948 - RNA, 27 nt, Artificial Sequence
  Synthetic Oligonucleotide
uaucagacuugcucccagucuggucca

SEQ ID NO: 949 - RNA, 27 nt, Artificial Sequence
  Synthetic Oligonucleotide
cuuaucagacuugcucccagucugguc

SEQ ID NO: 950 - RNA, 27 nt, Artificial Sequence
  Synthetic Oligonucleotide
uccuuaucagacuugcucccagucugg

SEQ ID NO: 951 - RNA, 27 nt, Artificial Sequence
  Synthetic Oligonucleotide
uuuccuuaucagacuugcucccagucu

SEQ ID NO: 952 - RNA, 27 nt, Artificial Sequence
  Synthetic Oligonucleotide
uguuuccuuaucagacuugcucccagu

SEQ ID NO: 953 - RNA, 27 nt, Artificial Sequence
  Synthetic Oligonucleotide
ucuguuuccuuaucagacuugcuccca

SEQ ID NO: 954 - RNA, 27 nt, Artificial Sequence
  Synthetic Oligonucleotide
uuucuguuuccuuaucagacuugcucc

SEQ ID NO: 955 - RNA, 27 nt, Artificial Sequence
  Synthetic Oligonucleotide
cuuuucuguuuccuuaucagacuugcu

SEQ ID NO: 956 - RNA, 27 nt, Artificial Sequence
  Synthetic Oligonucleotide
cccuuuucuguuuccuuaucagacuug

SEQ ID NO: 957 - RNA, 27 nt, Artificial Sequence
  Synthetic Oligonucleotide
cucccuuuucuguuuccuuaucagacu

SEQ ID NO: 958 - RNA, 27 nt, Artificial Sequence
  Synthetic Oligonucleotide
ugcucccuuuucuguuuccuuaucaga

SEQ ID NO: 959 - RNA, 27 nt, Artificial Sequence
  Synthetic Oligonucleotide
gaugcucccuuuucuguuuccuuauca

SEQ ID NO: 960 - RNA, 27 nt, Artificial Sequence
  Synthetic Oligonucleotide
gagaugcucccuuuucuguuuccuuau

SEQ ID NO: 961 - RNA, 27 nt, Artificial Sequence
  Synthetic Oligonucleotide
uugaugauuuuucaucuauucgagaug

SEQ ID NO: 962 - RNA, 27 nt, Artificial Sequence
  Synthetic Oligonucleotide
cuuugaugauuuuucaucuauucgaga

SEQ ID NO: 963 - RNA, 27 nt, Artificial Sequence
  Synthetic Oligonucleotide
gccuuugaugauuuuucaucuauucga

SEQ ID NO: 964 - RNA, 27 nt, Artificial Sequence
  Synthetic Oligonucleotide
uggccuuugaugauuuuucaucuauuc

SEQ ID NO: 965 - RNA, 27 nt, Artificial Sequence
  Synthetic Oligonucleotide
uuuggccuuugaugauuuuucaucuau

SEQ ID NO: 966 - RNA, 27 nt, Artificial Sequence
  Synthetic Oligonucleotide
acuuuggccuuugaugauuuuucaucu

SEQ ID NO: 967 - RNA, 27 nt, Artificial Sequence
  Synthetic Oligonucleotide
ucacuuuggccuuugaugauuuuucau

SEQ ID NO: 968 - RNA, 27 nt, Artificial Sequence
  Synthetic Oligonucleotide
auucacuuuggccuuugaugauuuuuc

SEQ ID NO: 969 - RNA, 27 nt, Artificial Sequence
  Synthetic Oligonucleotide
ucauucacuuuggccuuugaugauuuu

SEQ ID NO: 970 - RNA, 27 nt, Artificial Sequence
  Synthetic Oligonucleotide
uuaaaaaucucagcuaagaaaucauuc

SEQ ID NO: 971 - RNA, 27 nt, Artificial Sequence
  Synthetic Oligonucleotide
ucuuaaaaaucucagcuaagaaaucau

SEQ ID NO: 972 - RNA, 27 nt, Artificial Sequence
  Synthetic Oligonucleotide
cuucuuaaaaaucucagcuaagaaauc

SEQ ID NO: 973 - RNA, 27 nt, Artificial Sequence
  Synthetic Oligonucleotide
aucuucuuaaaaaucucagcuaagaaa

SEQ ID NO: 974 - RNA, 27 nt, Artificial Sequence
  Synthetic Oligonucleotide
caaucuucuuaaaaaucucagcuaaga

SEQ ID NO: 975 - RNA, 27 nt, Artificial Sequence
  Synthetic Oligonucleotide
gccaaucuucuuaaaaaucucagcuaa

SEQ ID NO: 976 - RNA, 27 nt, Artificial Sequence
  Synthetic Oligonucleotide
gagccaaucuucuuaaaaaucucagcu

SEQ ID NO: 977 - RNA, 27 nt, Artificial Sequence
  Synthetic Oligonucleotide
uagagccaaucuucuuaaaaaucucag

SEQ ID NO: 978 - RNA, 27 nt, Artificial Sequence
  Synthetic Oligonucleotide
uuuagagccaaucuucuuaaaaaucuc

SEQ ID NO: 979 - RNA, 27 nt, Artificial Sequence
  Synthetic Oligonucleotide
ucuuuagagccaaucuucuuaaaaauc

SEQ ID NO: 980 - RNA, 27 nt, Artificial Sequence
  Synthetic Oligonucleotide
uucuuauauucauauaacucugcuagu

SEQ ID NO: 981 - RNA, 27 nt, Artificial Sequence
  Synthetic Oligonucleotide
ucuucuuauauucauauaacucugcua

SEQ ID NO: 982 - RNA, 27 nt, Artificial Sequence
  Synthetic Oligonucleotide
uuucuucuuauauucauauaacucugc

SEQ ID NO: 983 - RNA, 27 nt, Artificial Sequence
  Synthetic Oligonucleotide
uauuucuucuuauauucauauaacucu

SEQ ID NO: 984 - RNA, 27 nt, Artificial Sequence
  Synthetic Oligonucleotide
aguauuucuucuuauauucauauaacu

SEQ ID NO: 985 - RNA, 27 nt, Artificial Sequence
  Synthetic Oligonucleotide
ugaguauuucuucuuauauucauauaa

SEQ ID NO: 986 - RNA, 27 nt, Artificial Sequence
  Synthetic Oligonucleotide
ucugaguauuucuucuuauauucauau

SEQ ID NO: 987 - RNA, 27 nt, Artificial Sequence
  Synthetic Oligonucleotide
auuuuucagaaaugguucaaugucagc

SEQ ID NO: 988 - RNA, 27 nt, Artificial Sequence
  Synthetic Oligonucleotide
gaauuuuucagaaaugguucaauguca

SEQ ID NO: 989 - RNA, 27 nt, Artificial Sequence
  Synthetic Oligonucleotide
aggaauuuuucagaaaugguucaaugu

SEQ ID NO: 990 - RNA, 27 nt, Artificial Sequence
  Synthetic Oligonucleotide
ugaggaauuuuucagaaaugguucaau

SEQ ID NO: 991 - RNA, 27 nt, Artificial Sequence
  Synthetic Oligonucleotide
ugugaggaauuuuucagaaaugguuca

SEQ ID NO: 992 - RNA, 27 nt, Artificial Sequence
  Synthetic Oligonucleotide
acugugaggaauuuuucagaaaugguu

SEQ ID NO: 993 - RNA, 27 nt, Artificial Sequence
  Synthetic Oligonucleotide
ccaucucaaucacccgaaggccucuuu

SEQ ID NO: 994 - RNA, 27 nt, Artificial Sequence
  Synthetic Oligonucleotide
cuccaucucaaucacccgaaggccucu

SEQ ID NO: 995 - RNA, 27 nt, Artificial Sequence
  Synthetic Oligonucleotide
cucuccaucucaaucacccgaaggccu

SEQ ID NO: 996 - RNA, 27 nt, Artificial Sequence
  Synthetic Oligonucleotide
cccucuccaucucaaucacccgaaggc

SEQ ID NO: 997 - RNA, 27 nt, Artificial Sequence
  Synthetic Oligonucleotide
cucccucuccaucucaaucacccgaag

SEQ ID NO: 998 - RNA, 27 nt, Artificial Sequence
  Synthetic Oligonucleotide
cccucccucuccaucucaaucacccga

SEQ ID NO: 999 - RNA, 27 nt, Artificial Sequence
  Synthetic Oligonucleotide
uuagccuuuccaaguagacagauggcc

SEQ ID NO: 1000 - RNA, 27 nt, Artificial Sequence
  Synthetic Oligonucleotide
cuuuagccuuuccaaguagacagaugg

SEQ ID NO: 1001 - RNA, 27 nt, Artificial Sequence
  Synthetic Oligonucleotide
aucuuuagccuuuccaaguagacagau

SEQ ID NO: 1002 - RNA, 27 nt, Artificial Sequence
  Synthetic Oligonucleotide
ggaucuuuagccuuuccaaguagacag

SEQ ID NO: 1003 - RNA, 27 nt, Artificial Sequence
  Synthetic Oligonucleotide
gcugguuuggagagcaaagaggucaaa

SEQ ID NO: 1004 - RNA, 27 nt, Artificial Sequence
  Synthetic Oligonucleotide
cugcugguuuggagagcaaagagguca

SEQ ID NO: 1005 - RNA, 27 nt, Artificial Sequence
  Synthetic Oligonucleotide
aacugcugguuuggagagcaaagaggu

SEQ ID NO: 1006 - RNA, 27 nt, Artificial Sequence
  Synthetic Oligonucleotide
ggaacugcugguuuggagagcaaagag

SEQ ID NO: 1007 - RNA, 27 nt, Artificial Sequence
  Synthetic Oligonucleotide
uuagcuguggaggaggaggaggucaca

SEQ ID NO: 1008 - RNA, 27 nt, Artificial Sequence
  Synthetic Oligonucleotide
gacugcucuuuauucucuccagucuuu

SEQ ID NO: 1009 - RNA, 27 nt, Artificial Sequence
  Synthetic Oligonucleotide
gcgacugcucuuuauucucuccagucu

SEQ ID NO: 1010 - RNA, 27 nt, Artificial Sequence
  Synthetic Oligonucleotide
uugcgacugcucuuuauucucuccagu

SEQ ID NO: 1011 - RNA, 27 nt, Artificial Sequence
  Synthetic Oligonucleotide
auuugcgacugcucuuuauucucucca

SEQ ID NO: 1012 - RNA, 27 nt, Artificial Sequence
  Synthetic Oligonucleotide
ucauuugcgacugcucuuuauucucuc

SEQ ID NO: 1013 - RNA, 27 nt, Artificial Sequence
  Synthetic Oligonucleotide
cuucauuugcgacugcucuuuauucuc

SEQ ID NO: 1014 - RNA, 27 nt, Artificial Sequence
  Synthetic Oligonucleotide
agcuucauuugcgacugcucuuuauuc

SEQ ID NO: 1015 - RNA, 27 nt, Artificial Sequence
  Synthetic Oligonucleotide
gcagcuucauuugcgacugcucuuuau

SEQ ID NO: 1016 - RNA, 27 nt, Artificial Sequence
  Synthetic Oligonucleotide
gggcagcuucauuugcgacugcucuuu

SEQ ID NO: 1017 - RNA, 27 nt, Artificial Sequence
  Synthetic Oligonucleotide
acggcaugauacauacaaccaguuugu

SEQ ID NO: 1018 - RNA, 27 nt, Artificial Sequence
  Synthetic Oligonucleotide
agauuaggacaauuuuacaaaugagca

SEQ ID NO: 1019 - RNA, 27 nt, Artificial Sequence
  Synthetic Oligonucleotide
aaagauuaggacaauuuuacaaaugag

SEQ ID NO: 1020 - RNA, 27 nt, Artificial Sequence
  Synthetic Oligonucleotide
ggaaagauuaggacaauuuuacaaaug

SEQ ID NO: 1021 - RNA, 27 nt, Artificial Sequence
  Synthetic Oligonucleotide
gccaugcauucauacagaauacaguga

SEQ ID NO: 1022 - RNA, 27 nt, Artificial Sequence
  Synthetic Oligonucleotide
augccaugcauucauacagaauacagu

SEQ ID NO: 1023 - RNA, 27 nt, Artificial Sequence
  Synthetic Oligonucleotide
ucaugccaugcauucauacagaauaca

SEQ ID NO: 1024 - RNA, 27 nt, Artificial Sequence
  Synthetic Oligonucleotide
uaucaugccaugcauucauacagaaua

SEQ ID NO: 1025 - RNA, 27 nt, Artificial Sequence
  Synthetic Oligonucleotide
uguaucaugccaugcauucauacagaa

SEQ ID NO: 1026 - RNA, 27 nt, Artificial Sequence
  Synthetic Oligonucleotide
guuguaucaugccaugcauucauacag

SEQ ID NO: 1027 - RNA, 27 nt, Artificial Sequence
  Synthetic Oligonucleotide
guuaaugcaaacuuuauuuauaaaaga

SEQ ID NO: 1028 - RNA, 27 nt, Artificial Sequence
  Synthetic Oligonucleotide
uaguuaaugcaaacuuuauuuauaaaa

SEQ ID NO: 1029 - RNA, 27 nt, Artificial Sequence
  Synthetic Oligonucleotide
uauaguuaaugcaaacuuuauuuauaa

SEQ ID NO: 1030 - RNA, 27 nt, Artificial Sequence
  Synthetic Oligonucleotide
gguauaguuaaugcaaacuuuauuuau

SEQ ID NO: 1031 - RNA, 27 nt, Artificial Sequence
  Synthetic Oligonucleotide
cagguauaguuaaugcaaacuuuauuu

SEQ ID NO: 1032 - RNA, 27 nt, Artificial Sequence
  Synthetic Oligonucleotide
gucagguauaguuaaugcaaacuuuau

SEQ ID NO: 1033 - RNA, 27 nt, Artificial Sequence
  Synthetic Oligonucleotide
agaauuaagaguauuuccucagcuggg

SEQ ID NO: 1034 - RNA, 27 nt, Artificial Sequence
  Synthetic Oligonucleotide
auuucugaucaacuggcaguuucaacc

SEQ ID NO: 1035 - RNA, 27 nt, Artificial Sequence
  Synthetic Oligonucleotide
guguucacauuucugaucaacuggcag

SEQ ID NO: 1036 - RNA, 27 nt, Artificial Sequence
  Synthetic Oligonucleotide
uucauacccacuuaaccuugcuuucca

SEQ ID NO: 1037 - RNA, 27 nt, Artificial Sequence
  Synthetic Oligonucleotide
aauccuaaaaauuuggaccacucuggg

SEQ ID NO: 1038 - RNA, 27 nt, Artificial Sequence
  Synthetic Oligonucleotide
cuucuaauccuuucaauugaaccacug

SEQ ID NO: 1039 - RNA, 27 nt, Artificial Sequence
  Synthetic Oligonucleotide
acauaaacaagugcagcuucuaauccu

SEQ ID NO: 1040 - RNA, 27 nt, Artificial Sequence
  Synthetic Oligonucleotide
gcauuuucaacauaaacaagugcagcu

SEQ ID NO: 1041 - RNA, 27 nt, Artificial Sequence
  Synthetic Oligonucleotide
acaacuucuccugugguuuuuccugcu

SEQ ID NO: 1042 - RNA, 27 nt, Artificial Sequence
  Synthetic Oligonucleotide
uugaacaccuuacuuacaacaccugac

SEQ ID NO: 1043 - RNA, 27 nt, Artificial Sequence
  Synthetic Oligonucleotide
guugauugaacaccuuacuuacaacac

SEQ ID NO: 1044 - RNA, 27 nt, Artificial Sequence
  Synthetic Oligonucleotide
uuggcuuuagcuuuagguugauugaac

SEQ ID NO: 1045 - RNA, 27 nt, Artificial Sequence
  Synthetic Oligonucleotide
auucuuauuguccaagccuuucaggag

SEQ ID NO: 1046 - RNA, 27 nt, Artificial Sequence
  Synthetic Oligonucleotide
uuggcaacacuuugauaauuggcuuaa

SEQ ID NO: 1047 - RNA, 27 nt, Artificial Sequence
  Synthetic Oligonucleotide
acucaaagaguuuuggcaacacuuuga

SEQ ID NO: 1048 - RNA, 27 nt, Artificial Sequence
  Synthetic Oligonucleotide
uucucucgagacucaaagaguuuuggc

SEQ ID NO: 1049 - RNA, 27 nt, Artificial Sequence
  Synthetic Oligonucleotide
auuaguuuggcuucaucucgaacagcc

SEQ ID NO: 1050 - RNA, 27 nt, Artificial Sequence
  Synthetic Oligonucleotide
ugaacagaguuuauauuuuguaauggg

SEQ ID NO: 1051 - RNA, 27 nt, Artificial Sequence
  Synthetic Oligonucleotide
uucaacugaacagaguuuauauuuugu

SEQ ID NO: 1052 - RNA, 27 nt, Artificial Sequence
  Synthetic Oligonucleotide
guucuuucaacugaacagaguuuauau

SEQ ID NO: 1053 - RNA, 27 nt, Artificial Sequence
  Synthetic Oligonucleotide
ucuucuaguucuuucaacugaacagag

SEQ ID NO: 1054 - RNA, 27 nt, Artificial Sequence
  Synthetic Oligonucleotide
aagcaucuauuuguggcaccucaucac

SEQ ID NO: 1055 - RNA, 27 nt, Artificial Sequence
  Synthetic Oligonucleotide
ucuaaaagcucauaagcaucuauuugu

SEQ ID NO: 1056 - RNA, 27 nt, Artificial Sequence
  Synthetic Oligonucleotide
auuucuacagcuucuaaaagcucauaa

SEQ ID NO: 1057 - RNA, 27 nt, Artificial Sequence
  Synthetic Oligonucleotide
auuaguacuucuacagacuccagggcc

SEQ ID NO: 1058 - RNA, 27 nt, Artificial Sequence
  Synthetic Oligonucleotide
uuuuuauuaguacuucuacagacucca

SEQ ID NO: 1059 - RNA, 27 nt, Artificial Sequence
  Synthetic Oligonucleotide
uucuuuaaugcuuuuacuaaaucugca

SEQ ID NO: 1060 - RNA, 27 nt, Artificial Sequence
  Synthetic Oligonucleotide
uccaacaaccuucuuuaaugcuuuuac

SEQ ID NO: 1061 - RNA, 27 nt, Artificial Sequence
  Synthetic Oligonucleotide
uccuuuccaacaaccuucuuuaaugcu

SEQ ID NO: 1062 - RNA, 27 nt, Artificial Sequence
  Synthetic Oligonucleotide
auugguguccuuuccaacaaccuucuu

SEQ ID NO: 1063 - RNA, 27 nt, Artificial Sequence
  Synthetic Oligonucleotide
ccugcauauuguccaaauuucuuccuu

SEQ ID NO: 1064 - RNA, 27 nt, Artificial Sequence
  Synthetic Oligonucleotide
uccauuacugcuaaaacauccucacug

SEQ ID NO: 1065 - RNA, 27 nt, Artificial Sequence
  Synthetic Oligonucleotide
uuuuauuauccauuacugcuaaaacau

SEQ ID NO: 1066 - RNA, 27 nt, Artificial Sequence
  Synthetic Oligonucleotide
aauaaaaagagaugucugcugcuugau

SEQ ID NO: 1067 - RNA, 27 nt, Artificial Sequence
  Synthetic Oligonucleotide
acuucuugcaauaaaaagagaugucug

SEQ ID NO: 1068 - RNA, 27 nt, Artificial Sequence
  Synthetic Oligonucleotide
aaugcuucaaaugcggcaucucugacu

SEQ ID NO: 1069 - RNA, 27 nt, Artificial Sequence
  Synthetic Oligonucleotide
accaccuucaaagcaguacccaaugcu

SEQ ID NO: 1070 - RNA, 27 nt, Artificial Sequence
  Synthetic Oligonucleotide
ucuuaucaagcuugaguuuguccacau

SEQ ID NO: 1071 - RNA, 27 nt, Artificial Sequence
  Synthetic Oligonucleotide
aguucuaccuuuucugaacauucuuug

SEQ ID NO: 1072 - RNA, 27 nt, Artificial Sequence
  Synthetic Oligonucleotide
cauguaucaguucuaccuuuucugaac

SEQ ID NO: 1073 - RNA, 27 nt, Artificial Sequence
  Synthetic Oligonucleotide
uuucuuaccauguaucaguucuaccuu

SEQ ID NO: 1074 - RNA, 27 nt, Artificial Sequence
  Synthetic Oligonucleotide
uuguucuugguuccaguauucccugcg

SEQ ID NO: 1075 - RNA, 27 nt, Artificial Sequence
  Synthetic Oligonucleotide
cacauacuucuaucgagagcucaggcu

SEQ ID NO: 1076 - RNA, 27 nt, Artificial Sequence
  Synthetic Oligonucleotide
gcuuuuucuucacauacuucuaucgag

SEQ ID NO: 1077 - RNA, 27 nt, Artificial Sequence
  Synthetic Oligonucleotide
uuucuuuccaguuacugcugucaagaa

SEQ ID NO: 1078 - RNA, 27 nt, Artificial Sequence
  Synthetic Oligonucleotide
uggcauuucaguucgguccauuagcuc

SEQ ID NO: 1079 - RNA, 27 nt, Artificial Sequence
  Synthetic Oligonucleotide
guuucuuggcuagcauccucacuaaug

SEQ ID NO: 1080 - RNA, 27 nt, Artificial Sequence
  Synthetic Oligonucleotide
uuucuuuccauccagguuucuuggcua

SEQ ID NO: 1081 - RNA, 27 nt, Artificial Sequence
  Synthetic Oligonucleotide
auuaguuucuuuccauccagguuucuu

SEQ ID NO: 1082 - RNA, 27 nt, Artificial Sequence
  Synthetic Oligonucleotide
cuauaugaagcuucauuugcaucaccu

SEQ ID NO: 1083 - RNA, 27 nt, Artificial Sequence
  Synthetic Oligonucleotide
ucuaauacaaccugagcugacguuuug

SEQ ID NO: 1084 - RNA, 27 nt, Artificial Sequence
  Synthetic Oligonucleotide
gcuauugcugucauagcuucuuuugca

SEQ ID NO: 1085 - RNA, 27 nt, Artificial Sequence
  Synthetic Oligonucleotide
aacauacaggcuucggcuauugcuguc

SEQ ID NO: 1086 - RNA, 27 nt, Artificial Sequence
  Synthetic Oligonucleotide
caguccaugguaacauacaggcuucgg

SEQ ID NO: 1087 - RNA, 27 nt, Artificial Sequence
  Synthetic Oligonucleotide
caauucagaguuucugacugauuuuug

SEQ ID NO: 1088 - RNA, 27 nt, Artificial Sequence
  Synthetic Oligonucleotide
ugucuucacauugcuaaugaaagcuuu

SEQ ID NO: 1089 - RNA, 27 nt, Artificial Sequence
  Synthetic Oligonucleotide
guggacuuugucccugcaucuucucaa

SEQ ID NO: 1090 - RNA, 27 nt, Artificial Sequence
  Synthetic Oligonucleotide
ggcaaaagaucaacgacaucauugcuc

SEQ ID NO: 1091 - RNA, 27 nt, Artificial Sequence
  Synthetic Oligonucleotide
cgucauuaauaauaccugccacuucau

SEQ ID NO: 1092 - RNA, 27 nt, Artificial Sequence
  Synthetic Oligonucleotide
aaucauugagucgacccuucaaggcag

SEQ ID NO: 1093 - RNA, 27 nt, Artificial Sequence
  Synthetic Oligonucleotide
auuugaaucauugagucgacccuucaa

SEQ ID NO: 1094 - RNA, 27 nt, Artificial Sequence
  Synthetic Oligonucleotide
aagauuuuauuugaaucauugagucga

SEQ ID NO: 1095 - RNA, 27 nt, Artificial Sequence
  Synthetic Oligonucleotide
uguaccaagauuuuauuugaaucauug

SEQ ID NO: 1096 - RNA, 27 nt, Artificial Sequence
  Synthetic Oligonucleotide
uugcuuaauauuugggcccauggcuac

SEQ ID NO: 1097 - RNA, 27 nt, Artificial Sequence
  Synthetic Oligonucleotide
auuuuuuacauguugcuuaauauuugg

SEQ ID NO: 1098 - RNA, 27 nt, Artificial Sequence
  Synthetic Oligonucleotide
aacauuguucuugcugucuccaaggac

SEQ ID NO: 1099 - RNA, 27 nt, Artificial Sequence
  Synthetic Oligonucleotide
gcucgaacauuguucuugcugucucca

SEQ ID NO: 1100 - RNA, 27 nt, Artificial Sequence
  Synthetic Oligonucleotide
uuuuucauauccuaaaugcaucaugaa

SEQ ID NO: 1101 - RNA, 27 nt, Artificial Sequence
  Synthetic Oligonucleotide
gcauguuaacuuuggcuuucucuagca

SEQ ID NO: 1102 - RNA, 27 nt, Artificial Sequence
  Synthetic Oligonucleotide
ugguuuugcuuggcaucuucuucccuu

SEQ ID NO: 1103 - RNA, 27 nt, Artificial Sequence
  Synthetic Oligonucleotide
ucaucuuucauccuuugcucuuuucca

SEQ ID NO: 1104 - RNA, 27 nt, Artificial Sequence
  Synthetic Oligonucleotide
cuuuuucaucuuucauccuuugcucuu

SEQ ID NO: 1105 - RNA, 27 nt, Artificial Sequence
  Synthetic Oligonucleotide
uuuaguugcucaauguauucaucccgu

SEQ ID NO: 1106 - RNA, 27 nt, Artificial Sequence
  Synthetic Oligonucleotide
gagucuuuaguugcucaauguauucau

SEQ ID NO: 1107 - RNA, 27 nt, Artificial Sequence
  Synthetic Oligonucleotide
ucaaaaaaccucaggguaagccacuuu

SEQ ID NO: 1108 - RNA, 27 nt, Artificial Sequence
  Synthetic Oligonucleotide
uguauuggugucaaaaaaccucagggu

SEQ ID NO: 1109 - RNA, 27 nt, Artificial Sequence
  Synthetic Oligonucleotide
ugcuuucaucaggacgcuuguauuggu

SEQ ID NO: 1110 - RNA, 27 nt, Artificial Sequence
  Synthetic Oligonucleotide
aauauucuagugcuuucaucaggacgc

SEQ ID NO: 1111 - RNA, 27 nt, Artificial Sequence
  Synthetic Oligonucleotide
auuuuaaauauucuagugcuuucauca

SEQ ID NO: 1112 - RNA, 27 nt, Artificial Sequence
  Synthetic Oligonucleotide
cucauauccuuuucagaaagauuucca

SEQ ID NO: 1113 - RNA, 27 nt, Artificial Sequence
  Synthetic Oligonucleotide
ccucgagcaugcucauauccuuuucag

SEQ ID NO: 1114 - RNA, 27 nt, Artificial Sequence
  Synthetic Oligonucleotide
uugcguaacauguuggcauuggagcuu

SEQ ID NO: 1115 - RNA, 27 nt, Artificial Sequence
  Synthetic Oligonucleotide
gucccuugcguaacauguuggcauugg

SEQ ID NO: 1116 - RNA, 27 nt, Artificial Sequence
  Synthetic Oligonucleotide
ugcugaacaaguucuggcauuucacau

SEQ ID NO: 1117 - RNA, 27 nt, Artificial Sequence
  Synthetic Oligonucleotide
uccaguuugugcugaacaaguucuggc

SEQ ID NO: 1118 - RNA, 27 nt, Artificial Sequence
  Synthetic Oligonucleotide
ggcucaaaaaugucauccaguuugugc

SEQ ID NO: 1119 - RNA, 27 nt, Artificial Sequence
  Synthetic Oligonucleotide
uaaggacuggcucaaaaaugucaucca

SEQ ID NO: 1120 - RNA, 27 nt, Artificial Sequence
  Synthetic Oligonucleotide
aggaauaaggacuggcucaaaaauguc

SEQ ID NO: 1121 - RNA, 27 nt, Artificial Sequence
  Synthetic Oligonucleotide
uggguucaggaauaaggacuggcucaa

SEQ ID NO: 1122 - RNA, 27 nt, Artificial Sequence
  Synthetic Oligonucleotide
ugcauuaggucuuuuaguacuccagug

SEQ ID NO: 1123 - RNA, 27 nt, Artificial Sequence
  Synthetic Oligonucleotide
ggucugacuucuccagaaccuucacca

SEQ ID NO: 1124 - RNA, 27 nt, Artificial Sequence
  Synthetic Oligonucleotide
gagcaaaacaaguagggcacucaggau

SEQ ID NO: 1125 - RNA, 27 nt, Artificial Sequence
  Synthetic Oligonucleotide
ucugagaauuugggagaacuggcuguu

SEQ ID NO: 1126 - RNA, 27 nt, Artificial Sequence
  Synthetic Oligonucleotide
ucuccagagacacuucauaacaagcuc

SEQ ID NO: 1127 - RNA, 27 nt, Artificial Sequence
  Synthetic Oligonucleotide
uauugaugguaucaggcaacagucgaa

SEQ ID NO: 1128 - RNA, 27 nt, Artificial Sequence
  Synthetic Oligonucleotide
aaugcuauugaugguaucaggcaacag

SEQ ID NO: 1129 - RNA, 27 nt, Artificial Sequence
  Synthetic Oligonucleotide
agguuaaugcuauugaugguaucaggc

SEQ ID NO: 1130 - RNA, 27 nt, Artificial Sequence
  Synthetic Oligonucleotide
uucugucuagguuaaugcuauugaugg

SEQ ID NO: 1131 - RNA, 27 nt, Artificial Sequence
  Synthetic Oligonucleotide
aagaauucugucuagguuaaugcuauu

SEQ ID NO: 1132 - RNA, 27 nt, Artificial Sequence
  Synthetic Oligonucleotide
aaaauguggauauccagaagaauucug

SEQ ID NO: 1133 - RNA, 27 nt, Artificial Sequence
  Synthetic Oligonucleotide
ccuucaugaaaauguggauauccagaa

SEQ ID NO: 1134 - RNA, 27 nt, Artificial Sequence
  Synthetic Oligonucleotide
uuuugcauugcuucaguuucucuuugg

SEQ ID NO: 1135 - RNA, 27 nt, Artificial Sequence
  Synthetic Oligonucleotide
uucacuuuugcauugcuucaguuucuc

SEQ ID NO: 1136 - RNA, 27 nt, Artificial Sequence
  Synthetic Oligonucleotide
gguccauacugugcuucaucauccggc

SEQ ID NO: 1137 - RNA, 27 nt, Artificial Sequence
  Synthetic Oligonucleotide
ucuauucgagaugcucccuuuucuguu

SEQ ID NO: 1138 - RNA, 27 nt, Artificial Sequence
  Synthetic Oligonucleotide
uuuucaucuauucgagaugcucccuuu

SEQ ID NO: 1139 - RNA, 27 nt, Artificial Sequence
  Synthetic Oligonucleotide
augauuuuucaucuauucgagaugcuc

SEQ ID NO: 1140 - RNA, 27 nt, Artificial Sequence
  Synthetic Oligonucleotide
auucauauaacucugcuagucccucuu

SEQ ID NO: 1141 - RNA, 27 nt, Artificial Sequence
  Synthetic Oligonucleotide
aaugguucaaugucagcaucugaguau

SEQ ID NO: 1142 - RNA, 27 nt, Artificial Sequence
  Synthetic Oligonucleotide
ucugguuagaauccaggucugaaugcu

SEQ ID NO: 1143 - RNA, 27 nt, Artificial Sequence
  Synthetic Oligonucleotide
agugagucugguuagaauccaggucug

SEQ ID NO: 1144 - RNA, 27 nt, Artificial Sequence
  Synthetic Oligonucleotide
ugaagagugagucugguuagaauccag

SEQ ID NO: 1145 - RNA, 27 nt, Artificial Sequence
  Synthetic Oligonucleotide
uuuuuuucaagucgucuauguuagcug

SEQ ID NO: 1146 - RNA, 27 nt, Artificial Sequence
  Synthetic Oligonucleotide
cagucuuuuuuucaagucgucuauguu

SEQ ID NO: 1147 - RNA, 27 nt, Artificial Sequence
  Synthetic Oligonucleotide
cauuuuaaacuaugaggacuucuaguu

SEQ ID NO: 1148 - RNA, 27 nt, Artificial Sequence
  Synthetic Oligonucleotide
uacaagucuguacacuaaacucaucca

SEQ ID NO: 1149 - RNA, 27 nt, Artificial Sequence
  Synthetic Oligonucleotide
auuaaaaagaaaagaaaaggaucuggg

SEQ ID NO: 1150 - RNA, 27 nt, Artificial Sequence
  Synthetic Oligonucleotide
auuaggacaauuuuacaaaugagcaau

SEQ ID NO: 1151 - RNA, 27 nt, Artificial Sequence
  Synthetic Oligonucleotide
uucauacagaauacagugacccuucag

SEQ ID NO: 1152 - RNA, 27 nt, Artificial Sequence
  Synthetic Oligonucleotide
augcauucauacagaauacagugaccc

SEQ ID NO: 1153 - DNA, 27 bp, Artificial Sequence
  Synthetic Oligonucleotide
tggaagcacaatgggagatgacagtga

SEQ ID NO: 1154 - DNA, 27 bp, Artificial Sequence
  Synthetic Oligonucleotide
gaagcacaatgggagatgacagtgagt

SEQ ID NO: 1155 - DNA, 27 bp, Artificial Sequence
  Synthetic Oligonucleotide
agcacaatgggagatgacagtgagtgg

SEQ ID NO: 1156 - DNA, 27 bp, Artificial Sequence
  Synthetic Oligonucleotide
cacaatgggagatgacagtgagtggtt

SEQ ID NO: 1157 - DNA, 27 bp, Artificial Sequence
  Synthetic Oligonucleotide
caatgggagatgacagtgagtggttga

SEQ ID NO: 1158 - DNA, 27 bp, Artificial Sequence
  Synthetic Oligonucleotide
atgggagatgacagtgagtggttgaaa

SEQ ID NO: 1159 - DNA, 27 bp, Artificial Sequence
  Synthetic Oligonucleotide
gggagatgacagtgagtggttgaaact

SEQ ID NO: 1160 - DNA, 27 bp, Artificial Sequence
  Synthetic Oligonucleotide
gagatgacagtgagtggttgaaactgc

SEQ ID NO: 1161 - DNA, 27 bp, Artificial Sequence
  Synthetic Oligonucleotide
gatgacagtgagtggttgaaactgcca

SEQ ID NO: 1162 - DNA, 27 bp, Artificial Sequence
  Synthetic Oligonucleotide
ctgaagatcttccagaaaataaaggat

SEQ ID NO: 1163 - DNA, 27 bp, Artificial Sequence
  Synthetic Oligonucleotide
gaagatcttccagaaaataaaggatga

SEQ ID NO: 1164 - DNA, 27 bp, Artificial Sequence
  Synthetic Oligonucleotide
agatcttccagaaaataaaggatgaaa

SEQ ID NO: 1165 - DNA, 27 bp, Artificial Sequence
  Synthetic Oligonucleotide
atcttccagaaaataaaggatgaaaag

SEQ ID NO: 1166 - DNA, 27 bp, Artificial Sequence
  Synthetic Oligonucleotide
cttccagaaaataaaggatgaaaagag

SEQ ID NO: 1167 - DNA, 27 bp, Artificial Sequence
  Synthetic Oligonucleotide
tccagaaaataaaggatgaaaagagcc

SEQ ID NO: 1168 - DNA, 27 bp, Artificial Sequence
  Synthetic Oligonucleotide
cagaaaataaaggatgaaaagagccca

SEQ ID NO: 1169 - DNA, 27 bp, Artificial Sequence
  Synthetic Oligonucleotide
gaaaataaaggatgaaaagagcccaga

SEQ ID NO: 1170 - DNA, 27 bp, Artificial Sequence
  Synthetic Oligonucleotide
gatcaaaaaatttgtcactgattccaa

SEQ ID NO: 1171 - DNA, 27 bp, Artificial Sequence
  Synthetic Oligonucleotide
tcaaaaaatttgtcactgattccaatg

SEQ ID NO: 1172 - DNA, 27 bp, Artificial Sequence
  Synthetic Oligonucleotide
aaaaaatttgtcactgattccaatgca

SEQ ID NO: 1173 - DNA, 27 bp, Artificial Sequence
  Synthetic Oligonucleotide
aaaatttgtcactgattccaatgcagt

SEQ ID NO: 1174 - DNA, 27 bp, Artificial Sequence
  Synthetic Oligonucleotide
aatttgtcactgattccaatgcagtgg

SEQ ID NO: 1175 - DNA, 27 bp, Artificial Sequence
  Synthetic Oligonucleotide
tttgtcactgattccaatgcagtggtt

SEQ ID NO: 1176 - DNA, 27 bp, Artificial Sequence
  Synthetic Oligonucleotide
tgtcactgattccaatgcagtggttca

SEQ ID NO: 1177 - DNA, 27 bp, Artificial Sequence
  Synthetic Oligonucleotide
tcactgattccaatgcagtggttcaat

SEQ ID NO: 1178 - DNA, 27 bp, Artificial Sequence
  Synthetic Oligonucleotide
actgattccaatgcagtggttcaattg

SEQ ID NO: 1179 - DNA, 27 bp, Artificial Sequence
  Synthetic Oligonucleotide
tgattccaatgcagtggttcaattgaa

SEQ ID NO: 1180 - DNA, 27 bp, Artificial Sequence
  Synthetic Oligonucleotide
attccaatgcagtggttcaattgaaag

SEQ ID NO: 1181 - DNA, 27 bp, Artificial Sequence
  Synthetic Oligonucleotide
tccaatgcagtggttcaattgaaagga

SEQ ID NO: 1182 - DNA, 27 bp, Artificial Sequence
  Synthetic Oligonucleotide
caatgcagtggttcaattgaaaggatt

SEQ ID NO: 1183 - DNA, 27 bp, Artificial Sequence
  Synthetic Oligonucleotide
atgcagtggttcaattgaaaggattag

SEQ ID NO: 1184 - DNA, 27 bp, Artificial Sequence
  Synthetic Oligonucleotide
gcagtggttcaattgaaaggattagaa

SEQ ID NO: 1185 - DNA, 27 bp, Artificial Sequence
  Synthetic Oligonucleotide
ccaagatcatagtggcctgtatagaga

SEQ ID NO: 1186 - DNA, 27 bp, Artificial Sequence
  Synthetic Oligonucleotide
aagatcatagtggcctgtatagagaca

SEQ ID NO: 1187 - DNA, 27 bp, Artificial Sequence
  Synthetic Oligonucleotide
gatcatagtggcctgtatagagacact

SEQ ID NO: 1188 - DNA, 27 bp, Artificial Sequence
  Synthetic Oligonucleotide
gacactgaggaaagccttaagtgaatt

SEQ ID NO: 1189 - DNA, 27 bp, Artificial Sequence
  Synthetic Oligonucleotide
cactgaggaaagccttaagtgaatttg

SEQ ID NO: 1190 - DNA, 27 bp, Artificial Sequence
  Synthetic Oligonucleotide
ctgaggaaagccttaagtgaatttggt

SEQ ID NO: 1191 - DNA, 27 bp, Artificial Sequence
  Synthetic Oligonucleotide
gaggaaagccttaagtgaatttggttc

SEQ ID NO: 1192 - DNA, 27 bp, Artificial Sequence
  Synthetic Oligonucleotide
ggaaagccttaagtgaatttggttcca

SEQ ID NO: 1193 - DNA, 27 bp, Artificial Sequence
  Synthetic Oligonucleotide
aaagccttaagtgaatttggttccaaa

SEQ ID NO: 1194 - DNA, 27 bp, Artificial Sequence
  Synthetic Oligonucleotide
agccttaagtgaatttggttccaaaat

SEQ ID NO: 1195 - DNA, 27 bp, Artificial Sequence
  Synthetic Oligonucleotide
ccttaagtgaatttggttccaaaatca

SEQ ID NO: 1196 - DNA, 27 bp, Artificial Sequence
  Synthetic Oligonucleotide
ttaagtgaatttggttccaaaatcatc

SEQ ID NO: 1197 - DNA, 27 bp, Artificial Sequence
  Synthetic Oligonucleotide
aagtgaatttggttccaaaatcatctt

SEQ ID NO: 1198 - DNA, 27 bp, Artificial Sequence
  Synthetic Oligonucleotide
gtgaatttggttccaaaatcatcttgc

SEQ ID NO: 1199 - DNA, 27 bp, Artificial Sequence
  Synthetic Oligonucleotide
gaatttggttccaaaatcatcttgctt

SEQ ID NO: 1200 - DNA, 27 bp, Artificial Sequence
  Synthetic Oligonucleotide
ttcgttcccaacaagaactagaagcta

SEQ ID NO: 1201 - DNA, 27 bp, Artificial Sequence
  Synthetic Oligonucleotide
cgttcccaacaagaactagaagctaaa

SEQ ID NO: 1202 - DNA, 27 bp, Artificial Sequence
  Synthetic Oligonucleotide
ttcccaacaagaactagaagctaaatt

SEQ ID NO: 1203 - DNA, 27 bp, Artificial Sequence
  Synthetic Oligonucleotide
cccaacaagaactagaagctaaattgg

SEQ ID NO: 1204 - DNA, 27 bp, Artificial Sequence
  Synthetic Oligonucleotide
caacaagaactagaagctaaattggaa

SEQ ID NO: 1205 - DNA, 27 bp, Artificial Sequence
  Synthetic Oligonucleotide
acaacagtctgctggtggagatgctga

SEQ ID NO: 1206 - DNA, 27 bp, Artificial Sequence
  Synthetic Oligonucleotide
aacagtctgctggtggagatgctgaag

SEQ ID NO: 1207 - DNA, 27 bp, Artificial Sequence
  Synthetic Oligonucleotide
aggtggtgatgatggtgatgaggtgcc

SEQ ID NO: 1208 - DNA, 27 bp, Artificial Sequence
  Synthetic Oligonucleotide
gtggtgatgatggtgatgaggtgccac

SEQ ID NO: 1209 - DNA, 27 bp, Artificial Sequence
  Synthetic Oligonucleotide
aaatcctttccaaacttcccaaagact

SEQ ID NO: 1210 - DNA, 27 bp, Artificial Sequence
  Synthetic Oligonucleotide
atcctttccaaacttcccaaagacttt

SEQ ID NO: 1211 - DNA, 27 bp, Artificial Sequence
  Synthetic Oligonucleotide
cctttccaaacttcccaaagactttta

SEQ ID NO: 1212 - DNA, 27 bp, Artificial Sequence
  Synthetic Oligonucleotide
tttccaaacttcccaaagacttttatg

SEQ ID NO: 1213 - DNA, 27 bp, Artificial Sequence
  Synthetic Oligonucleotide
tccaaacttcccaaagacttttatgac

SEQ ID NO: 1214 - DNA, 27 bp, Artificial Sequence
  Synthetic Oligonucleotide
caaacttcccaaagacttttatgacaa

SEQ ID NO: 1215 - DNA, 27 bp, Artificial Sequence
  Synthetic Oligonucleotide
aacttcccaaagacttttatgacaaaa

SEQ ID NO: 1216 - DNA, 27 bp, Artificial Sequence
  Synthetic Oligonucleotide
cttcccaaagacttttatgacaaaatt

SEQ ID NO: 1217 - DNA, 27 bp, Artificial Sequence
  Synthetic Oligonucleotide
tcccaaagacttttatgacaaaattga

SEQ ID NO: 1218 - DNA, 27 bp, Artificial Sequence
  Synthetic Oligonucleotide
ccaaagacttttatgacaaaattgagg

SEQ ID NO: 1219 - DNA, 27 bp, Artificial Sequence
  Synthetic Oligonucleotide
aaagacttttatgacaaaattgaggca

SEQ ID NO: 1220 - DNA, 27 bp, Artificial Sequence
  Synthetic Oligonucleotide
agacttttatgacaaaattgaggcaaa

SEQ ID NO: 1221 - DNA, 27 bp, Artificial Sequence
  Synthetic Oligonucleotide
acttttatgacaaaattgaggcaaaaa

SEQ ID NO: 1222 - DNA, 27 bp, Artificial Sequence
  Synthetic Oligonucleotide
ttttatgacaaaattgaggcaaaaaaa

SEQ ID NO: 1223 - DNA, 27 bp, Artificial Sequence
  Synthetic Oligonucleotide
ttatgacaaaattgaggcaaaaaaatg

SEQ ID NO: 1224 - DNA, 27 bp, Artificial Sequence
  Synthetic Oligonucleotide
aaaatggcaagagagaaaagaggccct

SEQ ID NO: 1225 - DNA, 27 bp, Artificial Sequence
  Synthetic Oligonucleotide
gaaggttgttggaaaggacaccaatgt

SEQ ID NO: 1226 - DNA, 27 bp, Artificial Sequence
  Synthetic Oligonucleotide
aggttgttggaaaggacaccaatgtca

SEQ ID NO: 1227 - DNA, 27 bp, Artificial Sequence
  Synthetic Oligonucleotide
gttgttggaaaggacaccaatgtcatg

SEQ ID NO: 1228 - DNA, 27 bp, Artificial Sequence
  Synthetic Oligonucleotide
tgttggaaaggacaccaatgtcatgtt

SEQ ID NO: 1229 - DNA, 27 bp, Artificial Sequence
  Synthetic Oligonucleotide
ttggaaaggacaccaatgtcatgttgg

SEQ ID NO: 1230 - DNA, 27 bp, Artificial Sequence
  Synthetic Oligonucleotide
ggaaaggacaccaatgtcatgttggtg

SEQ ID NO: 1231 - DNA, 27 bp, Artificial Sequence
  Synthetic Oligonucleotide
aaaggacaccaatgtcatgttggtggc

SEQ ID NO: 1232 - DNA, 27 bp, Artificial Sequence
  Synthetic Oligonucleotide
aggacaccaatgtcatgttggtggctt

SEQ ID NO: 1233 - DNA, 27 bp, Artificial Sequence
  Synthetic Oligonucleotide
tggctttggcagcaaaatgtcttactg

SEQ ID NO: 1234 - DNA, 27 bp, Artificial Sequence
  Synthetic Oligonucleotide
gctttggcagcaaaatgtcttactggc

SEQ ID NO: 1235 - DNA, 27 bp, Artificial Sequence
  Synthetic Oligonucleotide
tttggcagcaaaatgtcttactggcct

SEQ ID NO: 1236 - DNA, 27 bp, Artificial Sequence
  Synthetic Oligonucleotide
tggcagcaaaatgtcttactggcctgg

SEQ ID NO: 1237 - DNA, 27 bp, Artificial Sequence
  Synthetic Oligonucleotide
gcagcaaaatgtcttactggcctggct

SEQ ID NO: 1238 - DNA, 27 bp, Artificial Sequence
  Synthetic Oligonucleotide
gaagaaatttggacaatatgcaggaca

SEQ ID NO: 1239 - DNA, 27 bp, Artificial Sequence
  Synthetic Oligonucleotide
agaaatttggacaatatgcaggacatg

SEQ ID NO: 1240 - DNA, 27 bp, Artificial Sequence
  Synthetic Oligonucleotide
aaatttggacaatatgcaggacatgtt

SEQ ID NO: 1241 - DNA, 27 bp, Artificial Sequence
  Synthetic Oligonucleotide
atttggacaatatgcaggacatgttgt

SEQ ID NO: 1242 - DNA, 27 bp, Artificial Sequence
  Synthetic Oligonucleotide
ttggacaatatgcaggacatgttgtgc

SEQ ID NO: 1243 - DNA, 27 bp, Artificial Sequence
  Synthetic Oligonucleotide
ggacaatatgcaggacatgttgtgcca

SEQ ID NO: 1244 - DNA, 27 bp, Artificial Sequence
  Synthetic Oligonucleotide
acaatatgcaggacatgttgtgccaac

SEQ ID NO: 1245 - DNA, 27 bp, Artificial Sequence
  Synthetic Oligonucleotide
aatatgcaggacatgttgtgccaacca

SEQ ID NO: 1246 - DNA, 27 bp, Artificial Sequence
  Synthetic Oligonucleotide
tatgcaggacatgttgtgccaaccatc

SEQ ID NO: 1247 - DNA, 27 bp, Artificial Sequence
  Synthetic Oligonucleotide
tgcaggacatgttgtgccaaccatctt

SEQ ID NO: 1248 - DNA, 27 bp, Artificial Sequence
  Synthetic Oligonucleotide
acctcaagtggtacaagccctgcagga

SEQ ID NO: 1249 - DNA, 27 bp, Artificial Sequence
  Synthetic Oligonucleotide
ctcaagtggtacaagccctgcaggagg

SEQ ID NO: 1250 - DNA, 27 bp, Artificial Sequence
  Synthetic Oligonucleotide
caagtggtacaagccctgcaggaggca

SEQ ID NO: 1251 - DNA, 27 bp, Artificial Sequence
  Synthetic Oligonucleotide
agtggtacaagccctgcaggaggcaat

SEQ ID NO: 1252 - DNA, 27 bp, Artificial Sequence
  Synthetic Oligonucleotide
tggtacaagccctgcaggaggcaattg

SEQ ID NO: 1253 - DNA, 27 bp, Artificial Sequence
  Synthetic Oligonucleotide
gtacaagccctgcaggaggcaattgat

SEQ ID NO: 1254 - DNA, 27 bp, Artificial Sequence
  Synthetic Oligonucleotide
acaagccctgcaggaggcaattgatgc

SEQ ID NO: 1255 - DNA, 27 bp, Artificial Sequence
  Synthetic Oligonucleotide
aagccctgcaggaggcaattgatgcaa

SEQ ID NO: 1256 - DNA, 27 bp, Artificial Sequence
  Synthetic Oligonucleotide
gccctgcaggaggcaattgatgcaatc

SEQ ID NO: 1257 - DNA, 27 bp, Artificial Sequence
  Synthetic Oligonucleotide
cctgcaggaggcaattgatgcaatctt

SEQ ID NO: 1258 - DNA, 27 bp, Artificial Sequence
  Synthetic Oligonucleotide
tgcaggaggcaattgatgcaatcttcc

SEQ ID NO: 1259 - DNA, 27 bp, Artificial Sequence
  Synthetic Oligonucleotide
caggaggcaattgatgcaatcttcctt

SEQ ID NO: 1260 - DNA, 27 bp, Artificial Sequence
  Synthetic Oligonucleotide
ggaggcaattgatgcaatcttccttac

SEQ ID NO: 1261 - DNA, 27 bp, Artificial Sequence
  Synthetic Oligonucleotide
aggcaattgatgcaatcttccttacta

SEQ ID NO: 1262 - DNA, 27 bp, Artificial Sequence
  Synthetic Oligonucleotide
ttactaccacactacagaacatcagtg

SEQ ID NO: 1263 - DNA, 27 bp, Artificial Sequence
  Synthetic Oligonucleotide
actaccacactacagaacatcagtgag

SEQ ID NO: 1264 - DNA, 27 bp, Artificial Sequence
  Synthetic Oligonucleotide
taccacactacagaacatcagtgagga

SEQ ID NO: 1265 - DNA, 27 bp, Artificial Sequence
  Synthetic Oligonucleotide
ccacactacagaacatcagtgaggatg

SEQ ID NO: 1266 - DNA, 27 bp, Artificial Sequence
  Synthetic Oligonucleotide
acactacagaacatcagtgaggatgtt

SEQ ID NO: 1267 - DNA, 27 bp, Artificial Sequence
  Synthetic Oligonucleotide
actacagaacatcagtgaggatgtttt

SEQ ID NO: 1268 - DNA, 27 bp, Artificial Sequence
  Synthetic Oligonucleotide
tacagaacatcagtgaggatgttttag

SEQ ID NO: 1269 - DNA, 27 bp, Artificial Sequence
  Synthetic Oligonucleotide
ttttagcagtaatggataataaaaatc

SEQ ID NO: 1270 - DNA, 27 bp, Artificial Sequence
  Synthetic Oligonucleotide
ttagcagtaatggataataaaaatcca

SEQ ID NO: 1271 - DNA, 27 bp, Artificial Sequence
  Synthetic Oligonucleotide
agcagtaatggataataaaaatccaac

SEQ ID NO: 1272 - DNA, 27 bp, Artificial Sequence
  Synthetic Oligonucleotide
cagtaatggataataaaaatccaacca

SEQ ID NO: 1273 - DNA, 27 bp, Artificial Sequence
  Synthetic Oligonucleotide
caaccatcaagcagcagacatctcttt

SEQ ID NO: 1274 - DNA, 27 bp, Artificial Sequence
  Synthetic Oligonucleotide
cactacttaagcacatcaatgattctg

SEQ ID NO: 1275 - DNA, 27 bp, Artificial Sequence
  Synthetic Oligonucleotide
ctacttaagcacatcaatgattctgct

SEQ ID NO: 1276 - DNA, 27 bp, Artificial Sequence
  Synthetic Oligonucleotide
acttaagcacatcaatgattctgctcc

SEQ ID NO: 1277 - DNA, 27 bp, Artificial Sequence
  Synthetic Oligonucleotide
ttaagcacatcaatgattctgctcctg

SEQ ID NO: 1278 - DNA, 27 bp, Artificial Sequence
  Synthetic Oligonucleotide
aagcacatcaatgattctgctcctgaa

SEQ ID NO: 1279 - DNA, 27 bp, Artificial Sequence
  Synthetic Oligonucleotide
gcacatcaatgattctgctcctgaagt

SEQ ID NO: 1280 - DNA, 27 bp, Artificial Sequence
  Synthetic Oligonucleotide
acatcaatgattctgctcctgaagtca

SEQ ID NO: 1281 - DNA, 27 bp, Artificial Sequence
  Synthetic Oligonucleotide
atcaatgattctgctcctgaagtcaga

SEQ ID NO: 1282 - DNA, 27 bp, Artificial Sequence
  Synthetic Oligonucleotide
caatgattctgctcctgaagtcagaga

SEQ ID NO: 1283 - DNA, 27 bp, Artificial Sequence
  Synthetic Oligonucleotide
atgattctgctcctgaagtcagagatg

SEQ ID NO: 1284 - DNA, 27 bp, Artificial Sequence
  Synthetic Oligonucleotide
gattctgctcctgaagtcagagatgcc

SEQ ID NO: 1285 - DNA, 27 bp, Artificial Sequence
  Synthetic Oligonucleotide
ttctgctcctgaagtcagagatgccgc

SEQ ID NO: 1286 - DNA, 27 bp, Artificial Sequence
  Synthetic Oligonucleotide
ctgctcctgaagtcagagatgccgcat

SEQ ID NO: 1287 - DNA, 27 bp, Artificial Sequence
  Synthetic Oligonucleotide
aagatcaaagaatgttcagaaaaggta

SEQ ID NO: 1288 - DNA, 27 bp, Artificial Sequence
  Synthetic Oligonucleotide
gatcaaagaatgttcagaaaaggtaga

SEQ ID NO: 1289 - DNA, 27 bp, Artificial Sequence
  Synthetic Oligonucleotide
gaaacctggatggaaagaaactaattt

SEQ ID NO: 1290 - DNA, 27 bp, Artificial Sequence
  Synthetic Oligonucleotide
aacctggatggaaagaaactaattttc

SEQ ID NO: 1291 - DNA, 27 bp, Artificial Sequence
  Synthetic Oligonucleotide
cctggatggaaagaaactaattttcag

SEQ ID NO: 1292 - DNA, 27 bp, Artificial Sequence
  Synthetic Oligonucleotide
tggatggaaagaaactaattttcaggt

SEQ ID NO: 1293 - DNA, 27 bp, Artificial Sequence
  Synthetic Oligonucleotide
gatggaaagaaactaattttcaggtga

SEQ ID NO: 1294 - DNA, 27 bp, Artificial Sequence
  Synthetic Oligonucleotide
tggaaagaaactaattttcaggtgatg

SEQ ID NO: 1295 - DNA, 27 bp, Artificial Sequence
  Synthetic Oligonucleotide
gaaagaaactaattttcaggtgatgca

SEQ ID NO: 1296 - DNA, 27 bp, Artificial Sequence
  Synthetic Oligonucleotide
aagaaactaattttcaggtgatgcaaa

SEQ ID NO: 1297 - DNA, 27 bp, Artificial Sequence
  Synthetic Oligonucleotide
gaaactaattttcaggtgatgcaaatg

SEQ ID NO: 1298 - DNA, 27 bp, Artificial Sequence
  Synthetic Oligonucleotide
aactaattttcaggtgatgcaaatgaa

SEQ ID NO: 1299 - DNA, 27 bp, Artificial Sequence
  Synthetic Oligonucleotide
agttgctttgattgcccagaagggaaa

SEQ ID NO: 1300 - DNA, 27 bp, Artificial Sequence
  Synthetic Oligonucleotide
ttgctttgattgcccagaagggaaatt

SEQ ID NO: 1301 - DNA, 27 bp, Artificial Sequence
  Synthetic Oligonucleotide
gctttgattgcccagaagggaaatttt

SEQ ID NO: 1302 - DNA, 27 bp, Artificial Sequence
  Synthetic Oligonucleotide
tttgattgcccagaagggaaatttttc

SEQ ID NO: 1303 - DNA, 27 bp, Artificial Sequence
  Synthetic Oligonucleotide
tgattgcccagaagggaaatttttcca

SEQ ID NO: 1304 - DNA, 27 bp, Artificial Sequence
  Synthetic Oligonucleotide
attgcccagaagggaaatttttccaaa

SEQ ID NO: 1305 - DNA, 27 bp, Artificial Sequence
  Synthetic Oligonucleotide
tgcccagaagggaaatttttccaaaac

SEQ ID NO: 1306 - DNA, 27 bp, Artificial Sequence
  Synthetic Oligonucleotide
tggacaagattggagatgtgaaatgtg

SEQ ID NO: 1307 - DNA, 27 bp, Artificial Sequence
  Synthetic Oligonucleotide
gacaagattggagatgtgaaatgtggg

SEQ ID NO: 1308 - DNA, 27 bp, Artificial Sequence
  Synthetic Oligonucleotide
caagattggagatgtgaaatgtgggaa

SEQ ID NO: 1309 - DNA, 27 bp, Artificial Sequence
  Synthetic Oligonucleotide
agattggagatgtgaaatgtgggaaca

SEQ ID NO: 1310 - DNA, 27 bp, Artificial Sequence
  Synthetic Oligonucleotide
attggagatgtgaaatgtgggaacaat

SEQ ID NO: 1311 - DNA, 27 bp, Artificial Sequence
  Synthetic Oligonucleotide
tggagatgtgaaatgtgggaacaatgc

SEQ ID NO: 1312 - DNA, 27 bp, Artificial Sequence
  Synthetic Oligonucleotide
gagatgtgaaatgtgggaacaatgcaa

SEQ ID NO: 1313 - DNA, 27 bp, Artificial Sequence
  Synthetic Oligonucleotide
gatgtgaaatgtgggaacaatgcaaaa

SEQ ID NO: 1314 - DNA, 27 bp, Artificial Sequence
  Synthetic Oligonucleotide
tgtgaaatgtgggaacaatgcaaaaga

SEQ ID NO: 1315 - DNA, 27 bp, Artificial Sequence
  Synthetic Oligonucleotide
tgaaatgtgggaacaatgcaaaagaag

SEQ ID NO: 1316 - DNA, 27 bp, Artificial Sequence
  Synthetic Oligonucleotide
aaatgtgggaacaatgcaaaagaagct

SEQ ID NO: 1317 - DNA, 27 bp, Artificial Sequence
  Synthetic Oligonucleotide
atgtgggaacaatgcaaaagaagctat

SEQ ID NO: 1318 - DNA, 27 bp, Artificial Sequence
  Synthetic Oligonucleotide
gtgggaacaatgcaaaagaagctatga

SEQ ID NO: 1319 - DNA, 27 bp, Artificial Sequence
  Synthetic Oligonucleotide
gggttgaatgtcaaagctttcattagc

SEQ ID NO: 1320 - DNA, 27 bp, Artificial Sequence
  Synthetic Oligonucleotide
gttgaatgtcaaagctttcattagcaa

SEQ ID NO: 1321 - DNA, 27 bp, Artificial Sequence
  Synthetic Oligonucleotide
tgaatgtcaaagctttcattagcaatg

SEQ ID NO: 1322 - DNA, 27 bp, Artificial Sequence
  Synthetic Oligonucleotide
aatgtcaaagctttcattagcaatgtg

SEQ ID NO: 1323 - DNA, 27 bp, Artificial Sequence
  Synthetic Oligonucleotide
tgtcaaagctttcattagcaatgtgaa

SEQ ID NO: 1324 - DNA, 27 bp, Artificial Sequence
  Synthetic Oligonucleotide
aaccctgcttggcgtgatgtatctgta

SEQ ID NO: 1325 - DNA, 27 bp, Artificial Sequence
  Synthetic Oligonucleotide
ccctgcttggcgtgatgtatctgtatg

SEQ ID NO: 1326 - DNA, 27 bp, Artificial Sequence
  Synthetic Oligonucleotide
gttctttgaggatgagaagcctgccct

SEQ ID NO: 1327 - DNA, 27 bp, Artificial Sequence
  Synthetic Oligonucleotide
tctttgaggatgagaagcctgccctcc

SEQ ID NO: 1328 - DNA, 27 bp, Artificial Sequence
  Synthetic Oligonucleotide
tttgaggatgagaagcctgccctccta

SEQ ID NO: 1329 - DNA, 27 bp, Artificial Sequence
  Synthetic Oligonucleotide
tgaggatgagaagcctgccctcctatc

SEQ ID NO: 1330 - DNA, 27 bp, Artificial Sequence
  Synthetic Oligonucleotide
aggatgagaagcctgccctcctatccc

SEQ ID NO: 1331 - DNA, 27 bp, Artificial Sequence
  Synthetic Oligonucleotide
gatgagaagcctgccctcctatcccag

SEQ ID NO: 1332 - DNA, 27 bp, Artificial Sequence
  Synthetic Oligonucleotide
tgagaagcctgccctcctatcccagat

SEQ ID NO: 1333 - DNA, 27 bp, Artificial Sequence
  Synthetic Oligonucleotide
agaagcctgccctcctatcccagatag

SEQ ID NO: 1334 - DNA, 27 bp, Artificial Sequence
  Synthetic Oligonucleotide
aagcctgccctcctatcccagatagat

SEQ ID NO: 1335 - DNA, 27 bp, Artificial Sequence
  Synthetic Oligonucleotide
gcctgccctcctatcccagatagatgc

SEQ ID NO: 1336 - DNA, 27 bp, Artificial Sequence
  Synthetic Oligonucleotide
ctgccctcctatcccagatagatgcag

SEQ ID NO: 1337 - DNA, 27 bp, Artificial Sequence
  Synthetic Oligonucleotide
gccctcctatcccagatagatgcagaa

SEQ ID NO: 1338 - DNA, 27 bp, Artificial Sequence
  Synthetic Oligonucleotide
cctcctatcccagatagatgcagaatt

SEQ ID NO: 1339 - DNA, 27 bp, Artificial Sequence
  Synthetic Oligonucleotide
tcctatcccagatagatgcagaatttg

SEQ ID NO: 1340 - DNA, 27 bp, Artificial Sequence
  Synthetic Oligonucleotide
ctatcccagatagatgcagaatttgag

SEQ ID NO: 1341 - DNA, 27 bp, Artificial Sequence
  Synthetic Oligonucleotide
atcccagatagatgcagaatttgagaa

SEQ ID NO: 1342 - DNA, 27 bp, Artificial Sequence
  Synthetic Oligonucleotide
agaagatgcagggacaaagtccacctg

SEQ ID NO: 1343 - DNA, 27 bp, Artificial Sequence
  Synthetic Oligonucleotide
ggtacagatgaaggagaagatggagat

SEQ ID NO: 1344 - DNA, 27 bp, Artificial Sequence
  Synthetic Oligonucleotide
tacagatgaaggagaagatggagatga

SEQ ID NO: 1345 - DNA, 27 bp, Artificial Sequence
  Synthetic Oligonucleotide
cagatgaaggagaagatggagatgaac

SEQ ID NO: 1346 - DNA, 27 bp, Artificial Sequence
  Synthetic Oligonucleotide
tcgttgatcttttgccgaggacggaga

SEQ ID NO: 1347 - DNA, 27 bp, Artificial Sequence
  Synthetic Oligonucleotide
taggaaagaaggcctagatgaagtggc

SEQ ID NO: 1348 - DNA, 27 bp, Artificial Sequence
  Synthetic Oligonucleotide
ggaaagaaggcctagatgaagtggcag

SEQ ID NO: 1349 - DNA, 27 bp, Artificial Sequence
  Synthetic Oligonucleotide
aaagaaggcctagatgaagtggcaggt

SEQ ID NO: 1350 - DNA, 27 bp, Artificial Sequence
  Synthetic Oligonucleotide
agaaggcctagatgaagtggcaggtat

SEQ ID NO: 1351 - DNA, 27 bp, Artificial Sequence
  Synthetic Oligonucleotide
aaggcctagatgaagtggcaggtatta

SEQ ID NO: 1352 - DNA, 27 bp, Artificial Sequence
  Synthetic Oligonucleotide
ggcctagatgaagtggcaggtattatt

SEQ ID NO: 1353 - DNA, 27 bp, Artificial Sequence
  Synthetic Oligonucleotide
cctagatgaagtggcaggtattattaa

SEQ ID NO: 1354 - DNA, 27 bp, Artificial Sequence
  Synthetic Oligonucleotide
tagatgaagtggcaggtattattaatg

SEQ ID NO: 1355 - DNA, 27 bp, Artificial Sequence
  Synthetic Oligonucleotide
cgaatataggtgaacttccaactgcct

SEQ ID NO: 1356 - DNA, 27 bp, Artificial Sequence
  Synthetic Oligonucleotide
aatataggtgaacttccaactgccttg

SEQ ID NO: 1357 - DNA, 27 bp, Artificial Sequence
  Synthetic Oligonucleotide
tataggtgaacttccaactgccttgaa

SEQ ID NO: 1358 - DNA, 27 bp, Artificial Sequence
  Synthetic Oligonucleotide
taggtgaacttccaactgccttgaagg

SEQ ID NO: 1359 - DNA, 27 bp, Artificial Sequence
  Synthetic Oligonucleotide
ggtgaacttccaactgccttgaagggt

SEQ ID NO: 1360 - DNA, 27 bp, Artificial Sequence
  Synthetic Oligonucleotide
tgaacttccaactgccttgaagggtcg

SEQ ID NO: 1361 - DNA, 27 bp, Artificial Sequence
  Synthetic Oligonucleotide
aacttccaactgccttgaagggtcgac

SEQ ID NO: 1362 - DNA, 27 bp, Artificial Sequence
  Synthetic Oligonucleotide
cttccaactgccttgaagggtcgactc

SEQ ID NO: 1363 - DNA, 27 bp, Artificial Sequence
  Synthetic Oligonucleotide
tccaactgccttgaagggtcgactcaa

SEQ ID NO: 1364 - DNA, 27 bp, Artificial Sequence
  Synthetic Oligonucleotide
caactgccttgaagggtcgactcaatg

SEQ ID NO: 1365 - DNA, 27 bp, Artificial Sequence
  Synthetic Oligonucleotide
aacaactggcagtagccatgggcccaa

SEQ ID NO: 1366 - DNA, 27 bp, Artificial Sequence
  Synthetic Oligonucleotide
acagcaagaacaatgttcgagctgctg

SEQ ID NO: 1367 - DNA, 27 bp, Artificial Sequence
  Synthetic Oligonucleotide
agcaagaacaatgttcgagctgctgcc

SEQ ID NO: 1368 - DNA, 27 bp, Artificial Sequence
  Synthetic Oligonucleotide
caagaacaatgttcgagctgctgccct

SEQ ID NO: 1369 - DNA, 27 bp, Artificial Sequence
  Synthetic Oligonucleotide
agaacaatgttcgagctgctgccctag

SEQ ID NO: 1370 - DNA, 27 bp, Artificial Sequence
  Synthetic Oligonucleotide
aacaatgttcgagctgctgccctagcg

SEQ ID NO: 1371 - DNA, 27 bp, Artificial Sequence
  Synthetic Oligonucleotide
caatgttcgagctgctgccctagcgac

SEQ ID NO: 1372 - DNA, 27 bp, Artificial Sequence
  Synthetic Oligonucleotide
atgttcgagctgctgccctagcgactg

SEQ ID NO: 1373 - DNA, 27 bp, Artificial Sequence
  Synthetic Oligonucleotide
cgactgtgaatgcttgggcagaacaga

SEQ ID NO: 1374 - DNA, 27 bp, Artificial Sequence
  Synthetic Oligonucleotide
actgtgaatgcttgggcagaacagact

SEQ ID NO: 1375 - DNA, 27 bp, Artificial Sequence
  Synthetic Oligonucleotide
tgtgaatgcttgggcagaacagactgg

SEQ ID NO: 1376 - DNA, 27 bp, Artificial Sequence
  Synthetic Oligonucleotide
aggagaagatctttctgaagagctcaa

SEQ ID NO: 1377 - DNA, 27 bp, Artificial Sequence
  Synthetic Oligonucleotide
gcctagaagatcgaaatggagatgtgc

SEQ ID NO: 1378 - DNA, 27 bp, Artificial Sequence
  Synthetic Oligonucleotide
ctagaagatcgaaatggagatgtgcga

SEQ ID NO: 1379 - DNA, 27 bp, Artificial Sequence
  Synthetic Oligonucleotide
agaagatcgaaatggagatgtgcgaaa

SEQ ID NO: 1380 - DNA, 27 bp, Artificial Sequence
  Synthetic Oligonucleotide
catgatgcatttaggatatgaaaaaat

SEQ ID NO: 1381 - DNA, 27 bp, Artificial Sequence
  Synthetic Oligonucleotide
tgatgcatttaggatatgaaaaaatgg

SEQ ID NO: 1382 - DNA, 27 bp, Artificial Sequence
  Synthetic Oligonucleotide
atgcatttaggatatgaaaaaatggcc

SEQ ID NO: 1383 - DNA, 27 bp, Artificial Sequence
  Synthetic Oligonucleotide
gcatttaggatatgaaaaaatggccaa

SEQ ID NO: 1384 - DNA, 27 bp, Artificial Sequence
  Synthetic Oligonucleotide
atttaggatatgaaaaaatggccaagg

SEQ ID NO: 1385 - DNA, 27 bp, Artificial Sequence
  Synthetic Oligonucleotide
ccaaggctactgggaaactaaagccaa

SEQ ID NO: 1386 - DNA, 27 bp, Artificial Sequence
  Synthetic Oligonucleotide
aaggctactgggaaactaaagccaact

SEQ ID NO: 1387 - DNA, 27 bp, Artificial Sequence
  Synthetic Oligonucleotide
ggctactgggaaactaaagccaacttc

SEQ ID NO: 1388 - DNA, 27 bp, Artificial Sequence
  Synthetic Oligonucleotide
ctactgggaaactaaagccaacttcta

SEQ ID NO: 1389 - DNA, 27 bp, Artificial Sequence
  Synthetic Oligonucleotide
actgggaaactaaagccaacttctaaa

SEQ ID NO: 1390 - DNA, 27 bp, Artificial Sequence
  Synthetic Oligonucleotide
tgggaaactaaagccaacttctaaaga

SEQ ID NO: 1391 - DNA, 27 bp, Artificial Sequence
  Synthetic Oligonucleotide
ggaaactaaagccaacttctaaagatc

SEQ ID NO: 1392 - DNA, 27 bp, Artificial Sequence
  Synthetic Oligonucleotide
aaactaaagccaacttctaaagatcag

SEQ ID NO: 1393 - DNA, 27 bp, Artificial Sequence
  Synthetic Oligonucleotide
actaaagccaacttctaaagatcaggt

SEQ ID NO: 1394 - DNA, 27 bp, Artificial Sequence
  Synthetic Oligonucleotide
taaagccaacttctaaagatcaggtat

SEQ ID NO: 1395 - DNA, 27 bp, Artificial Sequence
  Synthetic Oligonucleotide
ggcctatttttattgttgttccaaatg

SEQ ID NO: 1396 - DNA, 27 bp, Artificial Sequence
  Synthetic Oligonucleotide
cctatttttattgttgttccaaatgga

SEQ ID NO: 1397 - DNA, 27 bp, Artificial Sequence
  Synthetic Oligonucleotide
tatttttattgttgttccaaatggaaa

SEQ ID NO: 1398 - DNA, 27 bp, Artificial Sequence
  Synthetic Oligonucleotide
tttttattgttgttccaaatggaaaag

SEQ ID NO: 1399 - DNA, 27 bp, Artificial Sequence
  Synthetic Oligonucleotide
tttattgttgttccaaatggaaaagag

SEQ ID NO: 1400 - DNA, 27 bp, Artificial Sequence
  Synthetic Oligonucleotide
tattgttgttccaaatggaaaagagca

SEQ ID NO: 1401 - DNA, 27 bp, Artificial Sequence
  Synthetic Oligonucleotide
gaaggtgctaaagtggaattttactac

SEQ ID NO: 1402 - DNA, 27 bp, Artificial Sequence
  Synthetic Oligonucleotide
aggtgctaaagtggaattttactaccc

SEQ ID NO: 1403 - DNA, 27 bp, Artificial Sequence
  Synthetic Oligonucleotide
atatcatcttactgagaatgaagcatc

SEQ ID NO: 1404 - DNA, 27 bp, Artificial Sequence
  Synthetic Oligonucleotide
atcatcttactgagaatgaagcatctt

SEQ ID NO: 1405 - DNA, 27 bp, Artificial Sequence
  Synthetic Oligonucleotide
catcttactgagaatgaagcatcttcc

SEQ ID NO: 1406 - DNA, 27 bp, Artificial Sequence
  Synthetic Oligonucleotide
tcttactgagaatgaagcatcttcctt

SEQ ID NO: 1407 - DNA, 27 bp, Artificial Sequence
  Synthetic Oligonucleotide
gtcaaggttggagaaccaaaggatgtc

SEQ ID NO: 1408 - DNA, 27 bp, Artificial Sequence
  Synthetic Oligonucleotide
caaggttggagaaccaaaggatgtcat

SEQ ID NO: 1409 - DNA, 27 bp, Artificial Sequence
  Synthetic Oligonucleotide
aggttggagaaccaaaggatgtcattc

SEQ ID NO: 1410 - DNA, 27 bp, Artificial Sequence
  Synthetic Oligonucleotide
gttggagaaccaaaggatgtcattcgt

SEQ ID NO: 1411 - DNA, 27 bp, Artificial Sequence
  Synthetic Oligonucleotide
tggagaaccaaaggatgtcattcgtaa

SEQ ID NO: 1412 - DNA, 27 bp, Artificial Sequence
  Synthetic Oligonucleotide
gagaaccaaaggatgtcattcgtaaag

SEQ ID NO: 1413 - DNA, 27 bp, Artificial Sequence
  Synthetic Oligonucleotide
gaaccaaaggatgtcattcgtaaagat

SEQ ID NO: 1414 - DNA, 27 bp, Artificial Sequence
  Synthetic Oligonucleotide
accaaaggatgtcattcgtaaagatgt

SEQ ID NO: 1415 - DNA, 27 bp, Artificial Sequence
  Synthetic Oligonucleotide
caaaggatgtcattcgtaaagatgttc

SEQ ID NO: 1416 - DNA, 27 bp, Artificial Sequence
  Synthetic Oligonucleotide
aaggatgtcattcgtaaagatgttcgt

SEQ ID NO: 1417 - DNA, 27 bp, Artificial Sequence
  Synthetic Oligonucleotide
ggatgtcattcgtaaagatgttcgtgc

SEQ ID NO: 1418 - DNA, 27 bp, Artificial Sequence
  Synthetic Oligonucleotide
catcctgaaccggatgtgccttgtcta

SEQ ID NO: 1419 - DNA, 27 bp, Artificial Sequence
  Synthetic Oligonucleotide
tcctgaaccggatgtgccttgtctacc

SEQ ID NO: 1420 - DNA, 27 bp, Artificial Sequence
  Synthetic Oligonucleotide
ctgaaccggatgtgccttgtctaccca

SEQ ID NO: 1421 - DNA, 27 bp, Artificial Sequence
  Synthetic Oligonucleotide
gaaccggatgtgccttgtctacccagc

SEQ ID NO: 1422 - DNA, 27 bp, Artificial Sequence
  Synthetic Oligonucleotide
accggatgtgccttgtctacccagcta

SEQ ID NO: 1423 - DNA, 27 bp, Artificial Sequence
  Synthetic Oligonucleotide
cggatgtgccttgtctacccagctagc

SEQ ID NO: 1424 - DNA, 27 bp, Artificial Sequence
  Synthetic Oligonucleotide
gatgtgccttgtctacccagctagcaa

SEQ ID NO: 1425 - DNA, 27 bp, Artificial Sequence
  Synthetic Oligonucleotide
atccaaaaactctaagcagagagcaga

SEQ ID NO: 1426 - DNA, 27 bp, Artificial Sequence
  Synthetic Oligonucleotide
ccaaaaactctaagcagagagcagagt

SEQ ID NO: 1427 - DNA, 27 bp, Artificial Sequence
  Synthetic Oligonucleotide
aaaaactctaagcagagagcagagtgc

SEQ ID NO: 1428 - DNA, 27 bp, Artificial Sequence
  Synthetic Oligonucleotide
aaactctaagcagagagcagagtgcct

SEQ ID NO: 1429 - DNA, 27 bp, Artificial Sequence
  Synthetic Oligonucleotide
actctaagcagagagcagagtgcctgg

SEQ ID NO: 1430 - DNA, 27 bp, Artificial Sequence
  Synthetic Oligonucleotide
tctaagcagagagcagagtgcctggaa

SEQ ID NO: 1431 - DNA, 27 bp, Artificial Sequence
  Synthetic Oligonucleotide
taagcagagagcagagtgcctggaaga

SEQ ID NO: 1432 - DNA, 27 bp, Artificial Sequence
  Synthetic Oligonucleotide
agcagagagcagagtgcctggaagagc

SEQ ID NO: 1433 - DNA, 27 bp, Artificial Sequence
  Synthetic Oligonucleotide
cagagagcagagtgcctggaagagctg

SEQ ID NO: 1434 - DNA, 27 bp, Artificial Sequence
  Synthetic Oligonucleotide
gagagcagagtgcctggaagagctggg

SEQ ID NO: 1435 - DNA, 27 bp, Artificial Sequence
  Synthetic Oligonucleotide
gagcagagtgcctggaagagctgggat

SEQ ID NO: 1436 - DNA, 27 bp, Artificial Sequence
  Synthetic Oligonucleotide
cccaggaaaagccttaaaggaaatagc

SEQ ID NO: 1437 - DNA, 27 bp, Artificial Sequence
  Synthetic Oligonucleotide
ggatcaggtgttcaaactgattggaaa

SEQ ID NO: 1438 - DNA, 27 bp, Artificial Sequence
  Synthetic Oligonucleotide
atcaggtgttcaaactgattggaaatc

SEQ ID NO: 1439 - DNA, 27 bp, Artificial Sequence
  Synthetic Oligonucleotide
caggtgttcaaactgattggaaatctt

SEQ ID NO: 1440 - DNA, 27 bp, Artificial Sequence
  Synthetic Oligonucleotide
ggtgttcaaactgattggaaatctttc

SEQ ID NO: 1441 - DNA, 27 bp, Artificial Sequence
  Synthetic Oligonucleotide
tgttcaaactgattggaaatctttctg

SEQ ID NO: 1442 - DNA, 27 bp, Artificial Sequence
  Synthetic Oligonucleotide
ttcaaactgattggaaatctttctgaa

SEQ ID NO: 1443 - DNA, 27 bp, Artificial Sequence
  Synthetic Oligonucleotide
caaactgattggaaatctttctgaaaa

SEQ ID NO: 1444 - DNA, 27 bp, Artificial Sequence
  Synthetic Oligonucleotide
aactgattggaaatctttctgaaaagg

SEQ ID NO: 1445 - DNA, 27 bp, Artificial Sequence
  Synthetic Oligonucleotide
ttaagcggtcagcaaagagaccctctg

SEQ ID NO: 1446 - DNA, 27 bp, Artificial Sequence
  Synthetic Oligonucleotide
aagcggtcagcaaagagaccctctgct

SEQ ID NO: 1447 - DNA, 27 bp, Artificial Sequence
  Synthetic Oligonucleotide
gcggtcagcaaagagaccctctgctgc

SEQ ID NO: 1448 - DNA, 27 bp, Artificial Sequence
  Synthetic Oligonucleotide
ggtcagcaaagagaccctctgctgcac

SEQ ID NO: 1449 - DNA, 27 bp, Artificial Sequence
  Synthetic Oligonucleotide
tcagcaaagagaccctctgctgcacca

SEQ ID NO: 1450 - DNA, 27 bp, Artificial Sequence
  Synthetic Oligonucleotide
agcaaagagaccctctgctgcaccaat

SEQ ID NO: 1451 - DNA, 27 bp, Artificial Sequence
  Synthetic Oligonucleotide
caaagagaccctctgctgcaccaataa

SEQ ID NO: 1452 - DNA, 27 bp, Artificial Sequence
  Synthetic Oligonucleotide
gttacgcaagggaccagctgaggacat

SEQ ID NO: 1453 - DNA, 27 bp, Artificial Sequence
  Synthetic Oligonucleotide
tacgcaagggaccagctgaggacatgt

SEQ ID NO: 1454 - DNA, 27 bp, Artificial Sequence
  Synthetic Oligonucleotide
tccgccgagaattccagctggatctag

SEQ ID NO: 1455 - DNA, 27 bp, Artificial Sequence
  Synthetic Oligonucleotide
cgccgagaattccagctggatctagat

SEQ ID NO: 1456 - DNA, 27 bp, Artificial Sequence
  Synthetic Oligonucleotide
caagatccgggctgtttctccacactt

SEQ ID NO: 1457 - DNA, 27 bp, Artificial Sequence
  Synthetic Oligonucleotide
agatccgggctgtttctccacacttcg

SEQ ID NO: 1458 - DNA, 27 bp, Artificial Sequence
  Synthetic Oligonucleotide
tcgatgacatgcacagtaatacagcat

SEQ ID NO: 1459 - DNA, 27 bp, Artificial Sequence
  Synthetic Oligonucleotide
gatgacatgcacagtaatacagcatcc

SEQ ID NO: 1460 - DNA, 27 bp, Artificial Sequence
  Synthetic Oligonucleotide
tgacatgcacagtaatacagcatccac

SEQ ID NO: 1461 - DNA, 27 bp, Artificial Sequence
  Synthetic Oligonucleotide
acatgcacagtaatacagcatccacaa

SEQ ID NO: 1462 - DNA, 27 bp, Artificial Sequence
  Synthetic Oligonucleotide
atgcacagtaatacagcatccacaatc

SEQ ID NO: 1463 - DNA, 27 bp, Artificial Sequence
  Synthetic Oligonucleotide
gcacagtaatacagcatccacaatcaa

SEQ ID NO: 1464 - DNA, 27 bp, Artificial Sequence
  Synthetic Oligonucleotide
acagtaatacagcatccacaatcaatt

SEQ ID NO: 1465 - DNA, 27 bp, Artificial Sequence
  Synthetic Oligonucleotide
agtaatacagcatccacaatcaatttc

SEQ ID NO: 1466 - DNA, 27 bp, Artificial Sequence
  Synthetic Oligonucleotide
taatacagcatccacaatcaatttcat

SEQ ID NO: 1467 - DNA, 27 bp, Artificial Sequence
  Synthetic Oligonucleotide
atacagcatccacaatcaatttcatta

SEQ ID NO: 1468 - DNA, 27 bp, Artificial Sequence
  Synthetic Oligonucleotide
acagcatccacaatcaatttcattatc

SEQ ID NO: 1469 - DNA, 27 bp, Artificial Sequence
  Synthetic Oligonucleotide
agcatccacaatcaatttcattatctc

SEQ ID NO: 1470 - DNA, 27 bp, Artificial Sequence
  Synthetic Oligonucleotide
catccacaatcaatttcattatctccc

SEQ ID NO: 1471 - DNA, 27 bp, Artificial Sequence
  Synthetic Oligonucleotide
tccacaatcaatttcattatctcccaa

SEQ ID NO: 1472 - DNA, 27 bp, Artificial Sequence
  Synthetic Oligonucleotide
cacaatcaatttcattatctcccaagt

SEQ ID NO: 1473 - DNA, 27 bp, Artificial Sequence
  Synthetic Oligonucleotide
caatcaatttcattatctcccaagtag

SEQ ID NO: 1474 - DNA, 27 bp, Artificial Sequence
  Synthetic Oligonucleotide
atcaatttcattatctcccaagtagcc

SEQ ID NO: 1475 - DNA, 27 bp, Artificial Sequence
  Synthetic Oligonucleotide
caatttcattatctcccaagtagccag

SEQ ID NO: 1476 - DNA, 27 bp, Artificial Sequence
  Synthetic Oligonucleotide
atttcattatctcccaagtagccagtg

SEQ ID NO: 1477 - DNA, 27 bp, Artificial Sequence
  Synthetic Oligonucleotide
ttcattatctcccaagtagccagtggt

SEQ ID NO: 1478 - DNA, 27 bp, Artificial Sequence
  Synthetic Oligonucleotide
cattatctcccaagtagccagtggtga

SEQ ID NO: 1479 - DNA, 27 bp, Artificial Sequence
  Synthetic Oligonucleotide
ttatctcccaagtagccagtggtgaca

SEQ ID NO: 1480 - DNA, 27 bp, Artificial Sequence
  Synthetic Oligonucleotide
atctcccaagtagccagtggtgacatc

SEQ ID NO: 1481 - DNA, 27 bp, Artificial Sequence
  Synthetic Oligonucleotide
ctcccaagtagccagtggtgacatcaa

SEQ ID NO: 1482 - DNA, 27 bp, Artificial Sequence
  Synthetic Oligonucleotide
cccaagtagccagtggtgacatcaaca

SEQ ID NO: 1483 - DNA, 27 bp, Artificial Sequence
  Synthetic Oligonucleotide
ttgcccgggaggcctccactggagtac

SEQ ID NO: 1484 - DNA, 27 bp, Artificial Sequence
  Synthetic Oligonucleotide
gcccgggaggcctccactggagtacta

SEQ ID NO: 1485 - DNA, 27 bp, Artificial Sequence
  Synthetic Oligonucleotide
ccgggaggcctccactggagtactaaa

SEQ ID NO: 1486 - DNA, 27 bp, Artificial Sequence
  Synthetic Oligonucleotide
gggaggcctccactggagtactaaaag

SEQ ID NO: 1487 - DNA, 27 bp, Artificial Sequence
  Synthetic Oligonucleotide
tcatcaccttaatgctggattctcgga

SEQ ID NO: 1488 - DNA, 27 bp, Artificial Sequence
  Synthetic Oligonucleotide
atcaccttaatgctggattctcggatt

SEQ ID NO: 1489 - DNA, 27 bp, Artificial Sequence
  Synthetic Oligonucleotide
caccttaatgctggattctcggattga

SEQ ID NO: 1490 - DNA, 27 bp, Artificial Sequence
  Synthetic Oligonucleotide
ccttaatgctggattctcggattgaag

SEQ ID NO: 1491 - DNA, 27 bp, Artificial Sequence
  Synthetic Oligonucleotide
ttaatgctggattctcggattgaagat

SEQ ID NO: 1492 - DNA, 27 bp, Artificial Sequence
  Synthetic Oligonucleotide
aatgctggattctcggattgaagatct

SEQ ID NO: 1493 - DNA, 27 bp, Artificial Sequence
  Synthetic Oligonucleotide
tgctggattctcggattgaagatcttg

SEQ ID NO: 1494 - DNA, 27 bp, Artificial Sequence
  Synthetic Oligonucleotide
ctggattctcggattgaagatcttgag

SEQ ID NO: 1495 - DNA, 27 bp, Artificial Sequence
  Synthetic Oligonucleotide
ggattctcggattgaagatcttgagga

SEQ ID NO: 1496 - DNA, 27 bp, Artificial Sequence
  Synthetic Oligonucleotide
ctctgtgaacctcttggtggtgaaggt

SEQ ID NO: 1497 - DNA, 27 bp, Artificial Sequence
  Synthetic Oligonucleotide
ctgtgaacctcttggtggtgaaggttc

SEQ ID NO: 1498 - DNA, 27 bp, Artificial Sequence
  Synthetic Oligonucleotide
gtgaacctcttggtggtgaaggttctg

SEQ ID NO: 1499 - DNA, 27 bp, Artificial Sequence
  Synthetic Oligonucleotide
gaacctcttggtggtgaaggttctgga

SEQ ID NO: 1500 - DNA, 27 bp, Artificial Sequence
  Synthetic Oligonucleotide
aagacagcctgctagcaacagccagtt

SEQ ID NO: 1501 - DNA, 27 bp, Artificial Sequence
  Synthetic Oligonucleotide
ccagttctcccaaattctcagagcttg

SEQ ID NO: 1502 - DNA, 27 bp, Artificial Sequence
  Synthetic Oligonucleotide
agttctcccaaattctcagagcttgtt

SEQ ID NO: 1503 - DNA, 27 bp, Artificial Sequence
  Synthetic Oligonucleotide
ttctcccaaattctcagagcttgttat

SEQ ID NO: 1504 - DNA, 27 bp, Artificial Sequence
  Synthetic Oligonucleotide
ctcccaaattctcagagcttgttatga

SEQ ID NO: 1505 - DNA, 27 bp, Artificial Sequence
  Synthetic Oligonucleotide
cccaaattctcagagcttgttatgaag

SEQ ID NO: 1506 - DNA, 27 bp, Artificial Sequence
  Synthetic Oligonucleotide
caaattctcagagcttgttatgaagtg

SEQ ID NO: 1507 - DNA, 27 bp, Artificial Sequence
  Synthetic Oligonucleotide
aattctcagagcttgttatgaagtgtc

SEQ ID NO: 1508 - DNA, 27 bp, Artificial Sequence
  Synthetic Oligonucleotide
ttctcagagcttgttatgaagtgtctc

SEQ ID NO: 1509 - DNA, 27 bp, Artificial Sequence
  Synthetic Oligonucleotide
ctcagagcttgttatgaagtgtctctg

SEQ ID NO: 1510 - DNA, 27 bp, Artificial Sequence
  Synthetic Oligonucleotide
cagagcttgttatgaagtgtctctgga

SEQ ID NO: 1511 - DNA, 27 bp, Artificial Sequence
  Synthetic Oligonucleotide
atagcattaacctagacagaattcttc

SEQ ID NO: 1512 - DNA, 27 bp, Artificial Sequence
  Synthetic Oligonucleotide
agcattaacctagacagaattcttctg

SEQ ID NO: 1513 - DNA, 27 bp, Artificial Sequence
  Synthetic Oligonucleotide
cattaacctagacagaattcttctgga

SEQ ID NO: 1514 - DNA, 27 bp, Artificial Sequence
  Synthetic Oligonucleotide
ttaacctagacagaattcttctggata

SEQ ID NO: 1515 - DNA, 27 bp, Artificial Sequence
  Synthetic Oligonucleotide
aacctagacagaattcttctggatatc

SEQ ID NO: 1516 - DNA, 27 bp, Artificial Sequence
  Synthetic Oligonucleotide
cctagacagaattcttctggatatcca

SEQ ID NO: 1517 - DNA, 27 bp, Artificial Sequence
  Synthetic Oligonucleotide
tatccacattttcatgaaggtcttccc

SEQ ID NO: 1518 - DNA, 27 bp, Artificial Sequence
  Synthetic Oligonucleotide
ctgaagcaatgcaaaagtgaatttccc

SEQ ID NO: 1519 - DNA, 27 bp, Artificial Sequence
  Synthetic Oligonucleotide
gaagcaatgcaaaagtgaatttcccat

SEQ ID NO: 1520 - DNA, 27 bp, Artificial Sequence
  Synthetic Oligonucleotide
agcaatgcaaaagtgaatttcccataa

SEQ ID NO: 1521 - DNA, 27 bp, Artificial Sequence
  Synthetic Oligonucleotide
acagtatggaccagactgggagcaagt

SEQ ID NO: 1522 - DNA, 27 bp, Artificial Sequence
  Synthetic Oligonucleotide
agtatggaccagactgggagcaagtct

SEQ ID NO: 1523 - DNA, 27 bp, Artificial Sequence
  Synthetic Oligonucleotide
tatggaccagactgggagcaagtctga

SEQ ID NO: 1524 - DNA, 27 bp, Artificial Sequence
  Synthetic Oligonucleotide
tggaccagactgggagcaagtctgata

SEQ ID NO: 1525 - DNA, 27 bp, Artificial Sequence
  Synthetic Oligonucleotide
gaccagactgggagcaagtctgataag

SEQ ID NO: 1526 - DNA, 27 bp, Artificial Sequence
  Synthetic Oligonucleotide
ccagactgggagcaagtctgataagga

SEQ ID NO: 1527 - DNA, 27 bp, Artificial Sequence
  Synthetic Oligonucleotide
agactgggagcaagtctgataaggaaa

SEQ ID NO: 1528 - DNA, 27 bp, Artificial Sequence
  Synthetic Oligonucleotide
actgggagcaagtctgataaggaaaca

SEQ ID NO: 1529 - DNA, 27 bp, Artificial Sequence
  Synthetic Oligonucleotide
tgggagcaagtctgataaggaaacaga

SEQ ID NO: 1530 - DNA, 27 bp, Artificial Sequence
  Synthetic Oligonucleotide
ggagcaagtctgataaggaaacagaaa

SEQ ID NO: 1531 - DNA, 27 bp, Artificial Sequence
  Synthetic Oligonucleotide
agcaagtctgataaggaaacagaaaag

SEQ ID NO: 1532 - DNA, 27 bp, Artificial Sequence
  Synthetic Oligonucleotide
caagtctgataaggaaacagaaaaggg

SEQ ID NO: 1533 - DNA, 27 bp, Artificial Sequence
  Synthetic Oligonucleotide
agtctgataaggaaacagaaaagggag

SEQ ID NO: 1534 - DNA, 27 bp, Artificial Sequence
  Synthetic Oligonucleotide
tctgataaggaaacagaaaagggagca

SEQ ID NO: 1535 - DNA, 27 bp, Artificial Sequence
  Synthetic Oligonucleotide
tgataaggaaacagaaaagggagcatc

SEQ ID NO: 1536 - DNA, 27 bp, Artificial Sequence
  Synthetic Oligonucleotide
ataaggaaacagaaaagggagcatctc

SEQ ID NO: 1537 - DNA, 27 bp, Artificial Sequence
  Synthetic Oligonucleotide
catctcgaatagatgaaaaatcatcaa

SEQ ID NO: 1538 - DNA, 27 bp, Artificial Sequence
  Synthetic Oligonucleotide
tctcgaatagatgaaaaatcatcaaag

SEQ ID NO: 1539 - DNA, 27 bp, Artificial Sequence
  Synthetic Oligonucleotide
tcgaatagatgaaaaatcatcaaaggc

SEQ ID NO: 1540 - DNA, 27 bp, Artificial Sequence
  Synthetic Oligonucleotide
gaatagatgaaaaatcatcaaaggcca

SEQ ID NO: 1541 - DNA, 27 bp, Artificial Sequence
  Synthetic Oligonucleotide
atagatgaaaaatcatcaaaggccaaa

SEQ ID NO: 1542 - DNA, 27 bp, Artificial Sequence
  Synthetic Oligonucleotide
agatgaaaaatcatcaaaggccaaagt

SEQ ID NO: 1543 - DNA, 27 bp, Artificial Sequence
  Synthetic Oligonucleotide
atgaaaaatcatcaaaggccaaagtga

SEQ ID NO: 1544 - DNA, 27 bp, Artificial Sequence
  Synthetic Oligonucleotide
gaaaaatcatcaaaggccaaagtgaat

SEQ ID NO: 1545 - DNA, 27 bp, Artificial Sequence
  Synthetic Oligonucleotide
aaaatcatcaaaggccaaagtgaatga

SEQ ID NO: 1546 - DNA, 27 bp, Artificial Sequence
  Synthetic Oligonucleotide
gaatgatttcttagctgagatttttaa

SEQ ID NO: 1547 - DNA, 27 bp, Artificial Sequence
  Synthetic Oligonucleotide
atgatttcttagctgagatttttaaga

SEQ ID NO: 1548 - DNA, 27 bp, Artificial Sequence
  Synthetic Oligonucleotide
gatttcttagctgagatttttaagaag

SEQ ID NO: 1549 - DNA, 27 bp, Artificial Sequence
  Synthetic Oligonucleotide
tttcttagctgagatttttaagaagat

SEQ ID NO: 1550 - DNA, 27 bp, Artificial Sequence
  Synthetic Oligonucleotide
tcttagctgagatttttaagaagattg

SEQ ID NO: 1551 - DNA, 27 bp, Artificial Sequence
  Synthetic Oligonucleotide
ttagctgagatttttaagaagattggc

SEQ ID NO: 1552 - DNA, 27 bp, Artificial Sequence
  Synthetic Oligonucleotide
agctgagatttttaagaagattggctc

SEQ ID NO: 1553 - DNA, 27 bp, Artificial Sequence
  Synthetic Oligonucleotide
ctgagatttttaagaagattggctcta

SEQ ID NO: 1554 - DNA, 27 bp, Artificial Sequence
  Synthetic Oligonucleotide
gagatttttaagaagattggctctaaa

SEQ ID NO: 1555 - DNA, 27 bp, Artificial Sequence
  Synthetic Oligonucleotide
gatttttaagaagattggctctaaaga

SEQ ID NO: 1556 - DNA, 27 bp, Artificial Sequence
  Synthetic Oligonucleotide
actagcagagttatatgaatataagaa

SEQ ID NO: 1557 - DNA, 27 bp, Artificial Sequence
  Synthetic Oligonucleotide
tagcagagttatatgaatataagaaga

SEQ ID NO: 1558 - DNA, 27 bp, Artificial Sequence
  Synthetic Oligonucleotide
gcagagttatatgaatataagaagaaa

SEQ ID NO: 1559 - DNA, 27 bp, Artificial Sequence
  Synthetic Oligonucleotide
agagttatatgaatataagaagaaata

SEQ ID NO: 1560 - DNA, 27 bp, Artificial Sequence
  Synthetic Oligonucleotide
agttatatgaatataagaagaaatact

SEQ ID NO: 1561 - DNA, 27 bp, Artificial Sequence
  Synthetic Oligonucleotide
ttatatgaatataagaagaaatactca

SEQ ID NO: 1562 - DNA, 27 bp, Artificial Sequence
  Synthetic Oligonucleotide
atatgaatataagaagaaatactcaga

SEQ ID NO: 1563 - DNA, 27 bp, Artificial Sequence
  Synthetic Oligonucleotide
gctgacattgaaccatttctgaaaaat

SEQ ID NO: 1564 - DNA, 27 bp, Artificial Sequence
  Synthetic Oligonucleotide
tgacattgaaccatttctgaaaaattc

SEQ ID NO: 1565 - DNA, 27 bp, Artificial Sequence
  Synthetic Oligonucleotide
acattgaaccatttctgaaaaattcct

SEQ ID NO: 1566 - DNA, 27 bp, Artificial Sequence
  Synthetic Oligonucleotide
attgaaccatttctgaaaaattcctca

SEQ ID NO: 1567 - DNA, 27 bp, Artificial Sequence
  Synthetic Oligonucleotide
tgaaccatttctgaaaaattcctcaca

SEQ ID NO: 1568 - DNA, 27 bp, Artificial Sequence
  Synthetic Oligonucleotide
aaccatttctgaaaaattcctcacagt

SEQ ID NO: 1569 - DNA, 27 bp, Artificial Sequence
  Synthetic Oligonucleotide
aaagaggccttcgggtgattgagatgg

SEQ ID NO: 1570 - DNA, 27 bp, Artificial Sequence
  Synthetic Oligonucleotide
agaggccttcgggtgattgagatggag

SEQ ID NO: 1571 - DNA, 27 bp, Artificial Sequence
  Synthetic Oligonucleotide
aggccttcgggtgattgagatggagag

SEQ ID NO: 1572 - DNA, 27 bp, Artificial Sequence
  Synthetic Oligonucleotide
gccttcgggtgattgagatggagaggg

SEQ ID NO: 1573 - DNA, 27 bp, Artificial Sequence
  Synthetic Oligonucleotide
cttcgggtgattgagatggagagggag

SEQ ID NO: 1574 - DNA, 27 bp, Artificial Sequence
  Synthetic Oligonucleotide
tcgggtgattgagatggagagggaggg

SEQ ID NO: 1575 - DNA, 27 bp, Artificial Sequence
  Synthetic Oligonucleotide
ggccatctgtctacttggaaaggctaa

SEQ ID NO: 1576 - DNA, 27 bp, Artificial Sequence
  Synthetic Oligonucleotide
ccatctgtctacttggaaaggctaaag

SEQ ID NO: 1577 - DNA, 27 bp, Artificial Sequence
  Synthetic Oligonucleotide
atctgtctacttggaaaggctaaagat

SEQ ID NO: 1578 - DNA, 27 bp, Artificial Sequence
  Synthetic Oligonucleotide
ctgtctacttggaaaggctaaagatcc

SEQ ID NO: 1579 - DNA, 27 bp, Artificial Sequence
  Synthetic Oligonucleotide
tttgacctctttgctctccaaaccagc

SEQ ID NO: 1580 - DNA, 27 bp, Artificial Sequence
  Synthetic Oligonucleotide
tgacctctttgctctccaaaccagcag

SEQ ID NO: 1581 - DNA, 27 bp, Artificial Sequence
  Synthetic Oligonucleotide
acctctttgctctccaaaccagcagtt

SEQ ID NO: 1582 - DNA, 27 bp, Artificial Sequence
  Synthetic Oligonucleotide
ctctttgctctccaaaccagcagttcc

SEQ ID NO: 1583 - DNA, 27 bp, Artificial Sequence
  Synthetic Oligonucleotide
tgtgacctcctcctcctccacagctaa

SEQ ID NO: 1584 - DNA, 27 bp, Artificial Sequence
  Synthetic Oligonucleotide
aaagactggagagaataaagagcagtc

SEQ ID NO: 1585 - DNA, 27 bp, Artificial Sequence
  Synthetic Oligonucleotide
agactggagagaataaagagcagtcgc

SEQ ID NO: 1586 - DNA, 27 bp, Artificial Sequence
  Synthetic Oligonucleotide
actggagagaataaagagcagtcgcaa

SEQ ID NO: 1587 - DNA, 27 bp, Artificial Sequence
  Synthetic Oligonucleotide
tggagagaataaagagcagtcgcaaat

SEQ ID NO: 1588 - DNA, 27 bp, Artificial Sequence
  Synthetic Oligonucleotide
gagagaataaagagcagtcgcaaatga

SEQ ID NO: 1589 - DNA, 27 bp, Artificial Sequence
  Synthetic Oligonucleotide
gagaataaagagcagtcgcaaatgaag

SEQ ID NO: 1590 - DNA, 27 bp, Artificial Sequence
  Synthetic Oligonucleotide
gaataaagagcagtcgcaaatgaagct

SEQ ID NO: 1591 - DNA, 27 bp, Artificial Sequence
  Synthetic Oligonucleotide
ataaagagcagtcgcaaatgaagctgc

SEQ ID NO: 1592 - DNA, 27 bp, Artificial Sequence
  Synthetic Oligonucleotide
aaagagcagtcgcaaatgaagctgccc

SEQ ID NO: 1593 - DNA, 27 bp, Artificial Sequence
  Synthetic Oligonucleotide
acaaactggttgtatgtatcatgccgt

SEQ ID NO: 1594 - DNA, 27 bp, Artificial Sequence
  Synthetic Oligonucleotide
tgctcatttgtaaaattgtcctaatct

SEQ ID NO: 1595 - DNA, 27 bp, Artificial Sequence
  Synthetic Oligonucleotide
ctcatttgtaaaattgtcctaatcttt

SEQ ID NO: 1596 - DNA, 27 bp, Artificial Sequence
  Synthetic Oligonucleotide
catttgtaaaattgtcctaatctttcc

SEQ ID NO: 1597 - DNA, 27 bp, Artificial Sequence
  Synthetic Oligonucleotide
tcactgtattctgtatgaatgcatggc

SEQ ID NO: 1598 - DNA, 27 bp, Artificial Sequence
  Synthetic Oligonucleotide
actgtattctgtatgaatgcatggcat

SEQ ID NO: 1599 - DNA, 27 bp, Artificial Sequence
  Synthetic Oligonucleotide
tgtattctgtatgaatgcatggcatga

SEQ ID NO: 1600 - DNA, 27 bp, Artificial Sequence
  Synthetic Oligonucleotide
tattctgtatgaatgcatggcatgata

SEQ ID NO: 1601 - DNA, 27 bp, Artificial Sequence
  Synthetic Oligonucleotide
ttctgtatgaatgcatggcatgataca

SEQ ID NO: 1602 - DNA, 27 bp, Artificial Sequence
  Synthetic Oligonucleotide
ctgtatgaatgcatggcatgatacaac

SEQ ID NO: 1603 - DNA, 27 bp, Artificial Sequence
  Synthetic Oligonucleotide
tcttttataaataaagtttgcattaac

SEQ ID NO: 1604 - DNA, 27 bp, Artificial Sequence
  Synthetic Oligonucleotide
ttttataaataaagtttgcattaacta

SEQ ID NO: 1605 - DNA, 27 bp, Artificial Sequence
  Synthetic Oligonucleotide
ttataaataaagtttgcattaactata

SEQ ID NO: 1606 - DNA, 27 bp, Artificial Sequence
  Synthetic Oligonucleotide
ataaataaagtttgcattaactatacc

SEQ ID NO: 1607 - DNA, 27 bp, Artificial Sequence
  Synthetic Oligonucleotide
aaataaagtttgcattaactatacctg

SEQ ID NO: 1608 - DNA, 27 bp, Artificial Sequence
  Synthetic Oligonucleotide
ataaagtttgcattaactatacctgac

SEQ ID NO: 1609 - DNA, 27 bp, Artificial Sequence
  Synthetic Oligonucleotide
cccagctgaggaaatactcttaattct

SEQ ID NO: 1610 - DNA, 27 bp, Artificial Sequence
  Synthetic Oligonucleotide
ggttgaaactgccagttgatcagaaat

SEQ ID NO: 1611 - DNA, 27 bp, Artificial Sequence
  Synthetic Oligonucleotide
ctgccagttgatcagaaatgtgaacac

SEQ ID NO: 1612 - DNA, 27 bp, Artificial Sequence
  Synthetic Oligonucleotide
tggaaagcaaggttaagtgggtatgaa

SEQ ID NO: 1613 - DNA, 27 bp, Artificial Sequence
  Synthetic Oligonucleotide
cccagagtggtccaaatttttaggatt

SEQ ID NO: 1614 - DNA, 27 bp, Artificial Sequence
  Synthetic Oligonucleotide
cagtggttcaattgaaaggattagaag

SEQ ID NO: 1615 - DNA, 27 bp, Artificial Sequence
  Synthetic Oligonucleotide
aggattagaagctgcacttgtttatgt

SEQ ID NO: 1616 - DNA, 27 bp, Artificial Sequence
  Synthetic Oligonucleotide
agctgcacttgtttatgttgaaaatgc

SEQ ID NO: 1617 - DNA, 27 bp, Artificial Sequence
  Synthetic Oligonucleotide
agcaggaaaaaccacaggagaagttgt

SEQ ID NO: 1618 - DNA, 27 bp, Artificial Sequence
  Synthetic Oligonucleotide
gtcaggtgttgtaagtaaggtgttcaa

SEQ ID NO: 1619 - DNA, 27 bp, Artificial Sequence
  Synthetic Oligonucleotide
gtgttgtaagtaaggtgttcaatcaac

SEQ ID NO: 1620 - DNA, 27 bp, Artificial Sequence
  Synthetic Oligonucleotide
gttcaatcaacctaaagctaaagccaa

SEQ ID NO: 1621 - DNA, 27 bp, Artificial Sequence
  Synthetic Oligonucleotide
ctcctgaaaggcttggacaataagaat

SEQ ID NO: 1622 - DNA, 27 bp, Artificial Sequence
  Synthetic Oligonucleotide
ttaagccaattatcaaagtgttgccaa

SEQ ID NO: 1623 - DNA, 27 bp, Artificial Sequence
  Synthetic Oligonucleotide
tcaaagtgttgccaaaactctttgagt

SEQ ID NO: 1624 - DNA, 27 bp, Artificial Sequence
  Synthetic Oligonucleotide
gccaaaactctttgagtctcgagagaa

SEQ ID NO: 1625 - DNA, 27 bp, Artificial Sequence
  Synthetic Oligonucleotide
ggctgttcgagatgaagccaaactaat

SEQ ID NO: 1626 - DNA, 27 bp, Artificial Sequence
  Synthetic Oligonucleotide
cccattacaaaatataaactctgttca

SEQ ID NO: 1627 - DNA, 27 bp, Artificial Sequence
  Synthetic Oligonucleotide
acaaaatataaactctgttcagttgaa

SEQ ID NO: 1628 - DNA, 27 bp, Artificial Sequence
  Synthetic Oligonucleotide
atataaactctgttcagttgaaagaac

SEQ ID NO: 1629 - DNA, 27 bp, Artificial Sequence
  Synthetic Oligonucleotide
ctctgttcagttgaaagaactagaaga

SEQ ID NO: 1630 - DNA, 27 bp, Artificial Sequence
  Synthetic Oligonucleotide
gtgatgaggtgccacaaatagatgctt

SEQ ID NO: 1631 - DNA, 27 bp, Artificial Sequence
  Synthetic Oligonucleotide
acaaatagatgcttatgagcttttaga

SEQ ID NO: 1632 - DNA, 27 bp, Artificial Sequence
  Synthetic Oligonucleotide
ttatgagcttttagaagctgtagaaat

SEQ ID NO: 1633 - DNA, 27 bp, Artificial Sequence
  Synthetic Oligonucleotide
ggccctggagtctgtagaagtactaat

SEQ ID NO: 1634 - DNA, 27 bp, Artificial Sequence
  Synthetic Oligonucleotide
tggagtctgtagaagtactaataaaaa

SEQ ID NO: 1635 - DNA, 27 bp, Artificial Sequence
  Synthetic Oligonucleotide
tgcagatttagtaaaagcattaaagaa

SEQ ID NO: 1636 - DNA, 27 bp, Artificial Sequence
  Synthetic Oligonucleotide
gtaaaagcattaaagaaggttgttgga

SEQ ID NO: 1637 - DNA, 27 bp, Artificial Sequence
  Synthetic Oligonucleotide
agcattaaagaaggttgttggaaagga

SEQ ID NO: 1638 - DNA, 27 bp, Artificial Sequence
  Synthetic Oligonucleotide
aagaaggttgttggaaaggacaccaat

SEQ ID NO: 1639 - DNA, 27 bp, Artificial Sequence
  Synthetic Oligonucleotide
aaggaagaaatttggacaatatgcagg

SEQ ID NO: 1640 - DNA, 27 bp, Artificial Sequence
  Synthetic Oligonucleotide
cagtgaggatgttttagcagtaatgga

SEQ ID NO: 1641 - DNA, 27 bp, Artificial Sequence
  Synthetic Oligonucleotide
atgttttagcagtaatggataataaaa

SEQ ID NO: 1642 - DNA, 27 bp, Artificial Sequence
  Synthetic Oligonucleotide
atcaagcagcagacatctctttttatt

SEQ ID NO: 1643 - DNA, 27 bp, Artificial Sequence
  Synthetic Oligonucleotide
cagacatctctttttattgcaagaagt

SEQ ID NO: 1644 - DNA, 27 bp, Artificial Sequence
  Synthetic Oligonucleotide
agtcagagatgccgcatttgaagcatt

SEQ ID NO: 1645 - DNA, 27 bp, Artificial Sequence
  Synthetic Oligonucleotide
agcattgggtactgctttgaaggtggt

SEQ ID NO: 1646 - DNA, 27 bp, Artificial Sequence
  Synthetic Oligonucleotide
atgtggacaaactcaagcttgataaga

SEQ ID NO: 1647 - DNA, 27 bp, Artificial Sequence
  Synthetic Oligonucleotide
caaagaatgttcagaaaaggtagaact

SEQ ID NO: 1648 - DNA, 27 bp, Artificial Sequence
  Synthetic Oligonucleotide
gttcagaaaaggtagaactgatacatg

SEQ ID NO: 1649 - DNA, 27 bp, Artificial Sequence
  Synthetic Oligonucleotide
aaggtagaactgatacatggtaagaaa

SEQ ID NO: 1650 - DNA, 27 bp, Artificial Sequence
  Synthetic Oligonucleotide
cgcagggaatactggaaccaagaacaa

SEQ ID NO: 1651 - DNA, 27 bp, Artificial Sequence
  Synthetic Oligonucleotide
agcctgagctctcgatagaagtatgtg

SEQ ID NO: 1652 - DNA, 27 bp, Artificial Sequence
  Synthetic Oligonucleotide
ctcgatagaagtatgtgaagaaaaagc

SEQ ID NO: 1653 - DNA, 27 bp, Artificial Sequence
  Synthetic Oligonucleotide
ttcttgacagcagtaactggaaagaaa

SEQ ID NO: 1654 - DNA, 27 bp, Artificial Sequence
  Synthetic Oligonucleotide
gagctaatggaccgaactgaaatgcca

SEQ ID NO: 1655 - DNA, 27 bp, Artificial Sequence
  Synthetic Oligonucleotide
cattagtgaggatgctagccaagaaac

SEQ ID NO: 1656 - DNA, 27 bp, Artificial Sequence
  Synthetic Oligonucleotide
tagccaagaaacctggatggaaagaaa

SEQ ID NO: 1657 - DNA, 27 bp, Artificial Sequence
  Synthetic Oligonucleotide
aagaaacctggatggaaagaaactaat

SEQ ID NO: 1658 - DNA, 27 bp, Artificial Sequence
  Synthetic Oligonucleotide
aggtgatgcaaatgaagcttcatatag

SEQ ID NO: 1659 - DNA, 27 bp, Artificial Sequence
  Synthetic Oligonucleotide
caaaacgtcagctcaggttgtattaga

SEQ ID NO: 1660 - DNA, 27 bp, Artificial Sequence
  Synthetic Oligonucleotide
tgcaaaagaagctatgacagcaatagc

SEQ ID NO: 1661 - DNA, 27 bp, Artificial Sequence
  Synthetic Oligonucleotide
gacagcaatagccgaagcctgtatgtt

SEQ ID NO: 1662 - DNA, 27 bp, Artificial Sequence
  Synthetic Oligonucleotide
ccgaagcctgtatgttaccatggactg

SEQ ID NO: 1663 - DNA, 27 bp, Artificial Sequence
  Synthetic Oligonucleotide
caaaaatcagtcagaaactctgaattg

SEQ ID NO: 1664 - DNA, 27 bp, Artificial Sequence
  Synthetic Oligonucleotide
aaagctttcattagcaatgtgaagaca

SEQ ID NO: 1665 - DNA, 27 bp, Artificial Sequence
  Synthetic Oligonucleotide
ttgagaagatgcagggacaaagtccac

SEQ ID NO: 1666 - DNA, 27 bp, Artificial Sequence
  Synthetic Oligonucleotide
gagcaatgatgtcgttgatcttttgcc

SEQ ID NO: 1667 - DNA, 27 bp, Artificial Sequence
  Synthetic Oligonucleotide
atgaagtggcaggtattattaatgacg

SEQ ID NO: 1668 - DNA, 27 bp, Artificial Sequence
  Synthetic Oligonucleotide
ctgccttgaagggtcgactcaatgatt

SEQ ID NO: 1669 - DNA, 27 bp, Artificial Sequence
  Synthetic Oligonucleotide
ttgaagggtcgactcaatgattcaaat

SEQ ID NO: 1670 - DNA, 27 bp, Artificial Sequence
  Synthetic Oligonucleotide
tcgactcaatgattcaaataaaatctt

SEQ ID NO: 1671 - DNA, 27 bp, Artificial Sequence
  Synthetic Oligonucleotide
caatgattcaaataaaatcttggtaca

SEQ ID NO: 1672 - DNA, 27 bp, Artificial Sequence
  Synthetic Oligonucleotide
gtagccatgggcccaaatattaagcaa

SEQ ID NO: 1673 - DNA, 27 bp, Artificial Sequence
  Synthetic Oligonucleotide
ccaaatattaagcaacatgtaaaaaat

SEQ ID NO: 1674 - DNA, 27 bp, Artificial Sequence
  Synthetic Oligonucleotide
gtccttggagacagcaagaacaatgtt

SEQ ID NO: 1675 - DNA, 27 bp, Artificial Sequence
  Synthetic Oligonucleotide
tggagacagcaagaacaatgttcgagc

SEQ ID NO: 1676 - DNA, 27 bp, Artificial Sequence
  Synthetic Oligonucleotide
ttcatgatgcatttaggatatgaaaaa

SEQ ID NO: 1677 - DNA, 27 bp, Artificial Sequence
  Synthetic Oligonucleotide
tgctagagaaagccaaagttaacatgc

SEQ ID NO: 1678 - DNA, 27 bp, Artificial Sequence
  Synthetic Oligonucleotide
aagggaagaagatgccaagcaaaacca

SEQ ID NO: 1679 - DNA, 27 bp, Artificial Sequence
  Synthetic Oligonucleotide
tggaaaagagcaaaggatgaaagatga

SEQ ID NO: 1680 - DNA, 27 bp, Artificial Sequence
  Synthetic Oligonucleotide
aagagcaaaggatgaaagatgaaaaag

SEQ ID NO: 1681 - DNA, 27 bp, Artificial Sequence
  Synthetic Oligonucleotide
acgggatgaatacattgagcaactaaa

SEQ ID NO: 1682 - DNA, 27 bp, Artificial Sequence
  Synthetic Oligonucleotide
atgaatacattgagcaactaaagactc

SEQ ID NO: 1683 - DNA, 27 bp, Artificial Sequence
  Synthetic Oligonucleotide
aaagtggcttaccctgaggttttttga

SEQ ID NO: 1684 - DNA, 27 bp, Artificial Sequence
  Synthetic Oligonucleotide
accctgaggttttttgacaccaataca

SEQ ID NO: 1685 - DNA, 27 bp, Artificial Sequence
  Synthetic Oligonucleotide
accaatacaagcgtcctgatgaaagca

SEQ ID NO: 1686 - DNA, 27 bp, Artificial Sequence
  Synthetic Oligonucleotide
gcgtcctgatgaaagcactagaatatt

SEQ ID NO: 1687 - DNA, 27 bp, Artificial Sequence
  Synthetic Oligonucleotide
tgatgaaagcactagaatatttaaaat

SEQ ID NO: 1688 - DNA, 27 bp, Artificial Sequence
  Synthetic Oligonucleotide
tggaaatctttctgaaaaggatatgag

SEQ ID NO: 1689 - DNA, 27 bp, Artificial Sequence
  Synthetic Oligonucleotide
ctgaaaaggatatgagcatgctcgagg

SEQ ID NO: 1690 - DNA, 27 bp, Artificial Sequence
  Synthetic Oligonucleotide
aagctccaatgccaacatgttacgcaa

SEQ ID NO: 1691 - DNA, 27 bp, Artificial Sequence
  Synthetic Oligonucleotide
ccaatgccaacatgttacgcaagggac

SEQ ID NO: 1692 - DNA, 27 bp, Artificial Sequence
  Synthetic Oligonucleotide
atgtgaaatgccagaacttgttcagca

SEQ ID NO: 1693 - DNA, 27 bp, Artificial Sequence
  Synthetic Oligonucleotide
gccagaacttgttcagcacaaactgga

SEQ ID NO: 1694 - DNA, 27 bp, Artificial Sequence
  Synthetic Oligonucleotide
gcacaaactggatgacatttttgagcc

SEQ ID NO: 1695 - DNA, 27 bp, Artificial Sequence
  Synthetic Oligonucleotide
tggatgacatttttgagccagtcctta

SEQ ID NO: 1696 - DNA, 27 bp, Artificial Sequence
  Synthetic Oligonucleotide
gacatttttgagccagtccttattcct

SEQ ID NO: 1697 - DNA, 27 bp, Artificial Sequence
  Synthetic Oligonucleotide
ttgagccagtccttattcctgaaccca

SEQ ID NO: 1698 - DNA, 27 bp, Artificial Sequence
  Synthetic Oligonucleotide
cactggagtactaaaagacctaatgca

SEQ ID NO: 1699 - DNA, 27 bp, Artificial Sequence
  Synthetic Oligonucleotide
tggtgaaggttctggagaagtcagacc

SEQ ID NO: 1700 - DNA, 27 bp, Artificial Sequence
  Synthetic Oligonucleotide
atcctgagtgccctacttgttttgctc

SEQ ID NO: 1701 - DNA, 27 bp, Artificial Sequence
  Synthetic Oligonucleotide
aacagccagttctcccaaattctcaga

SEQ ID NO: 1702 - DNA, 27 bp, Artificial Sequence
  Synthetic Oligonucleotide
gagcttgttatgaagtgtctctggaga

SEQ ID NO: 1703 - DNA, 27 bp, Artificial Sequence
  Synthetic Oligonucleotide
ttcgactgttgcctgataccatcaata

SEQ ID NO: 1704 - DNA, 27 bp, Artificial Sequence
  Synthetic Oligonucleotide
ctgttgcctgataccatcaatagcatt

SEQ ID NO: 1705 - DNA, 27 bp, Artificial Sequence
  Synthetic Oligonucleotide
gcctgataccatcaatagcattaacct

SEQ ID NO: 1706 - DNA, 27 bp, Artificial Sequence
  Synthetic Oligonucleotide
ccatcaatagcattaacctagacagaa

SEQ ID NO: 1707 - DNA, 27 bp, Artificial Sequence
  Synthetic Oligonucleotide
aatagcattaacctagacagaattctt

SEQ ID NO: 1708 - DNA, 27 bp, Artificial Sequence
  Synthetic Oligonucleotide
cagaattcttctggatatccacatttt

SEQ ID NO: 1709 - DNA, 27 bp, Artificial Sequence
  Synthetic Oligonucleotide
ttctggatatccacattttcatgaagg

SEQ ID NO: 1710 - DNA, 27 bp, Artificial Sequence
  Synthetic Oligonucleotide
ccaaagagaaactgaagcaatgcaaaa

SEQ ID NO: 1711 - DNA, 27 bp, Artificial Sequence
  Synthetic Oligonucleotide
gagaaactgaagcaatgcaaaagtgaa

SEQ ID NO: 1712 - DNA, 27 bp, Artificial Sequence
  Synthetic Oligonucleotide
gccggatgatgaagcacagtatggacc

SEQ ID NO: 1713 - DNA, 27 bp, Artificial Sequence
  Synthetic Oligonucleotide
aacagaaaagggagcatctcgaataga

SEQ ID NO: 1714 - DNA, 27 bp, Artificial Sequence
  Synthetic Oligonucleotide
aaagggagcatctcgaatagatgaaaa

SEQ ID NO: 1715 - DNA, 27 bp, Artificial Sequence
  Synthetic Oligonucleotide
gagcatctcgaatagatgaaaaatcat

SEQ ID NO: 1716 - DNA, 27 bp, Artificial Sequence
  Synthetic Oligonucleotide
aagagggactagcagagttatatgaat

SEQ ID NO: 1717 - DNA, 27 bp, Artificial Sequence
  Synthetic Oligonucleotide
atactcagatgctgacattgaaccatt

SEQ ID NO: 1718 - DNA, 27 bp, Artificial Sequence
  Synthetic Oligonucleotide
agcattcagacctggattctaaccaga

SEQ ID NO: 1719 - DNA, 27 bp, Artificial Sequence
  Synthetic Oligonucleotide
cagacctggattctaaccagactcact

SEQ ID NO: 1720 - DNA, 27 bp, Artificial Sequence
  Synthetic Oligonucleotide
ctggattctaaccagactcactcttca

SEQ ID NO: 1721 - DNA, 27 bp, Artificial Sequence
  Synthetic Oligonucleotide
cagctaacatagacgacttgaaaaaaa

SEQ ID NO: 1722 - DNA, 27 bp, Artificial Sequence
  Synthetic Oligonucleotide
aacatagacgacttgaaaaaaagactg

SEQ ID NO: 1723 - DNA, 27 bp, Artificial Sequence
  Synthetic Oligonucleotide
aactagaagtcctcatagtttaaaatg

SEQ ID NO: 1724 - DNA, 27 bp, Artificial Sequence
  Synthetic Oligonucleotide
tggatgagtttagtgtacagacttgta

SEQ ID NO: 1725 - DNA, 27 bp, Artificial Sequence
  Synthetic Oligonucleotide
cccagatccttttcttttctttttaat

SEQ ID NO: 1726 - DNA, 27 bp, Artificial Sequence
  Synthetic Oligonucleotide
attgctcatttgtaaaattgtcctaat

SEQ ID NO: 1727 - DNA, 27 bp, Artificial Sequence
  Synthetic Oligonucleotide
ctgaagggtcactgtattctgtatgaa

SEQ ID NO: 1728 - DNA, 27 bp, Artificial Sequence
  Synthetic Oligonucleotide
gggtcactgtattctgtatgaatgcat

SEQ ID NO: 1729 - RNA, 25 nt, Artificial Sequence
  Synthetic Oligonucleotide
gaagcacaaugggagaugacaguga

SEQ ID NO: 1730 - RNA, 25 nt, Artificial Sequence
  Synthetic Oligonucleotide
agcacaaugggagaugacagugagu

SEQ ID NO: 1731 - RNA, 25 nt, Artificial Sequence
  Synthetic Oligonucleotide
cacaaugggagaugacagugagugg

SEQ ID NO: 1732 - RNA, 25 nt, Artificial Sequence
  Synthetic Oligonucleotide
caaugggagaugacagugagugguu

SEQ ID NO: 1733 - RNA, 25 nt, Artificial Sequence
  Synthetic Oligonucleotide
augggagaugacagugagugguuga

SEQ ID NO: 1734 - RNA, 25 nt, Artificial Sequence
  Synthetic Oligonucleotide
gggagaugacagugagugguugaaa

SEQ ID NO: 1735 - RNA, 25 nt, Artificial Sequence
  Synthetic Oligonucleotide
gagaugacagugagugguugaaacu

SEQ ID NO: 1736 - RNA, 25 nt, Artificial Sequence
  Synthetic Oligonucleotide
gaugacagugagugguugaaacugc

SEQ ID NO: 1737 - RNA, 25 nt, Artificial Sequence
  Synthetic Oligonucleotide
ugacagugagugguugaaacugcca

SEQ ID NO: 1738 - RNA, 25 nt, Artificial Sequence
  Synthetic Oligonucleotide
gaagaucuuccagaaaauaaaggau

SEQ ID NO: 1739 - RNA, 25 nt, Artificial Sequence
  Synthetic Oligonucleotide
agaucuuccagaaaauaaaggauga

SEQ ID NO: 1740 - RNA, 25 nt, Artificial Sequence
  Synthetic Oligonucleotide
aucuuccagaaaauaaaggaugaaa

SEQ ID NO: 1741 - RNA, 25 nt, Artificial Sequence
  Synthetic Oligonucleotide
cuuccagaaaauaaaggaugaaaag

SEQ ID NO: 1742 - RNA, 25 nt, Artificial Sequence
  Synthetic Oligonucleotide
uccagaaaauaaaggaugaaaagag

SEQ ID NO: 1743 - RNA, 25 nt, Artificial Sequence
  Synthetic Oligonucleotide
cagaaaauaaaggaugaaaagagcc

SEQ ID NO: 1744 - RNA, 25 nt, Artificial Sequence
  Synthetic Oligonucleotide
gaaaauaaaggaugaaaagagccca

SEQ ID NO: 1745 - RNA, 25 nt, Artificial Sequence
  Synthetic Oligonucleotide
aaauaaaggaugaaaagagcccaga

SEQ ID NO: 1746 - RNA, 25 nt, Artificial Sequence
  Synthetic Oligonucleotide
ucaaaaaauuugucacugauuccaa

SEQ ID NO: 1747 - RNA, 25 nt, Artificial Sequence
  Synthetic Oligonucleotide
aaaaaauuugucacugauuccaaug

SEQ ID NO: 1748 - RNA, 25 nt, Artificial Sequence
  Synthetic Oligonucleotide
aaaauuugucacugauuccaaugca

SEQ ID NO: 1749 - RNA, 25 nt, Artificial Sequence
  Synthetic Oligonucleotide
aauuugucacugauuccaaugcagu

SEQ ID NO: 1750 - RNA, 25 nt, Artificial Sequence
  Synthetic Oligonucleotide
uuugucacugauuccaaugcagugg

SEQ ID NO: 1751 - RNA, 25 nt, Artificial Sequence
  Synthetic Oligonucleotide
ugucacugauuccaaugcagugguu

SEQ ID NO: 1752 - RNA, 25 nt, Artificial Sequence
  Synthetic Oligonucleotide
ucacugauuccaaugcagugguuca

SEQ ID NO: 1753 - RNA, 25 nt, Artificial Sequence
  Synthetic Oligonucleotide
acugauuccaaugcagugguucaau

SEQ ID NO: 1754 - RNA, 25 nt, Artificial Sequence
  Synthetic Oligonucleotide
ugauuccaaugcagugguucaauug

SEQ ID NO: 1755 - RNA, 25 nt, Artificial Sequence
  Synthetic Oligonucleotide
auuccaaugcagugguucaauugaa

SEQ ID NO: 1756 - RNA, 25 nt, Artificial Sequence
  Synthetic Oligonucleotide
uccaaugcagugguucaauugaaag

SEQ ID NO: 1757 - RNA, 25 nt, Artificial Sequence
  Synthetic Oligonucleotide
caaugcagugguucaauugaaagga

SEQ ID NO: 1758 - RNA, 25 nt, Artificial Sequence
  Synthetic Oligonucleotide
augcagugguucaauugaaaggauu

SEQ ID NO: 1759 - RNA, 25 nt, Artificial Sequence
  Synthetic Oligonucleotide
gcagugguucaauugaaaggauuag

SEQ ID NO: 1760 - RNA, 25 nt, Artificial Sequence
  Synthetic Oligonucleotide
agugguucaauugaaaggauuagaa

SEQ ID NO: 1761 - RNA, 25 nt, Artificial Sequence
  Synthetic Oligonucleotide
aagaucauaguggccuguauagaga

SEQ ID NO: 1762 - RNA, 25 nt, Artificial Sequence
  Synthetic Oligonucleotide
gaucauaguggccuguauagagaca

SEQ ID NO: 1763 - RNA, 25 nt, Artificial Sequence
  Synthetic Oligonucleotide
ucauaguggccuguauagagacacu

SEQ ID NO: 1764 - RNA, 25 nt, Artificial Sequence
  Synthetic Oligonucleotide
cacugaggaaagccuuaagugaauu

SEQ ID NO: 1765 - RNA, 25 nt, Artificial Sequence
  Synthetic Oligonucleotide
cugaggaaagccuuaagugaauuug

SEQ ID NO: 1766 - RNA, 25 nt, Artificial Sequence
  Synthetic Oligonucleotide
gaggaaagccuuaagugaauuuggu

SEQ ID NO: 1767 - RNA, 25 nt, Artificial Sequence
  Synthetic Oligonucleotide
ggaaagccuuaagugaauuugguuc

SEQ ID NO: 1768 - RNA, 25 nt, Artificial Sequence
  Synthetic Oligonucleotide
aaagccuuaagugaauuugguucca

SEQ ID NO: 1769 - RNA, 25 nt, Artificial Sequence
  Synthetic Oligonucleotide
agccuuaagugaauuugguuccaaa

SEQ ID NO: 1770 - RNA, 25 nt, Artificial Sequence
  Synthetic Oligonucleotide
ccuuaagugaauuugguuccaaaau

SEQ ID NO: 1771 - RNA, 25 nt, Artificial Sequence
  Synthetic Oligonucleotide
uuaagugaauuugguuccaaaauca

SEQ ID NO: 1772 - RNA, 25 nt, Artificial Sequence
  Synthetic Oligonucleotide
aagugaauuugguuccaaaaucauc

SEQ ID NO: 1773 - RNA, 25 nt, Artificial Sequence
  Synthetic Oligonucleotide
gugaauuugguuccaaaaucaucuu

SEQ ID NO: 1774 - RNA, 25 nt, Artificial Sequence
  Synthetic Oligonucleotide
gaauuugguuccaaaaucaucuugc

SEQ ID NO: 1775 - RNA, 25 nt, Artificial Sequence
  Synthetic Oligonucleotide
auuugguuccaaaaucaucuugcuu

SEQ ID NO: 1776 - RNA, 25 nt, Artificial Sequence
  Synthetic Oligonucleotide
cguucccaacaagaacuagaagcua

SEQ ID NO: 1777 - RNA, 25 nt, Artificial Sequence
  Synthetic Oligonucleotide
uucccaacaagaacuagaagcuaaa

SEQ ID NO: 1778 - RNA, 25 nt, Artificial Sequence
  Synthetic Oligonucleotide
cccaacaagaacuagaagcuaaauu

SEQ ID NO: 1779 - RNA, 25 nt, Artificial Sequence
  Synthetic Oligonucleotide
caacaagaacuagaagcuaaauugg

SEQ ID NO: 1780 - RNA, 25 nt, Artificial Sequence
  Synthetic Oligonucleotide
acaagaacuagaagcuaaauuggaa

SEQ ID NO: 1781 - RNA, 25 nt, Artificial Sequence
  Synthetic Oligonucleotide
aacagucugcugguggagaugcuga

SEQ ID NO: 1782 - RNA, 25 nt, Artificial Sequence
  Synthetic Oligonucleotide
cagucugcugguggagaugcugaag

SEQ ID NO: 1783 - RNA, 25 nt, Artificial Sequence
  Synthetic Oligonucleotide
guggugaugauggugaugaggugcc

SEQ ID NO: 1784 - RNA, 25 nt, Artificial Sequence
  Synthetic Oligonucleotide
ggugaugauggugaugaggugccac

SEQ ID NO: 1785 - RNA, 25 nt, Artificial Sequence
  Synthetic Oligonucleotide
auccuuuccaaacuucccaaagacu

SEQ ID NO: 1786 - RNA, 25 nt, Artificial Sequence
  Synthetic Oligonucleotide
ccuuuccaaacuucccaaagacuuu

SEQ ID NO: 1787 - RNA, 25 nt, Artificial Sequence
  Synthetic Oligonucleotide
uuuccaaacuucccaaagacuuuua

SEQ ID NO: 1788 - RNA, 25 nt, Artificial Sequence
  Synthetic Oligonucleotide
uccaaacuucccaaagacuuuuaug

SEQ ID NO: 1789 - RNA, 25 nt, Artificial Sequence
  Synthetic Oligonucleotide
caaacuucccaaagacuuuuaugac

SEQ ID NO: 1790 - RNA, 25 nt, Artificial Sequence
  Synthetic Oligonucleotide
aacuucccaaagacuuuuaugacaa

SEQ ID NO: 1791 - RNA, 25 nt, Artificial Sequence
  Synthetic Oligonucleotide
cuucccaaagacuuuuaugacaaaa

SEQ ID NO: 1792 - RNA, 25 nt, Artificial Sequence
  Synthetic Oligonucleotide
ucccaaagacuuuuaugacaaaauu

SEQ ID NO: 1793 - RNA, 25 nt, Artificial Sequence
  Synthetic Oligonucleotide
ccaaagacuuuuaugacaaaauuga

SEQ ID NO: 1794 - RNA, 25 nt, Artificial Sequence
  Synthetic Oligonucleotide
aaagacuuuuaugacaaaauugagg

SEQ ID NO: 1795 - RNA, 25 nt, Artificial Sequence
  Synthetic Oligonucleotide
agacuuuuaugacaaaauugaggca

SEQ ID NO: 1796 - RNA, 25 nt, Artificial Sequence
  Synthetic Oligonucleotide
acuuuuaugacaaaauugaggcaaa

SEQ ID NO: 1797 - RNA, 25 nt, Artificial Sequence
  Synthetic Oligonucleotide
uuuuaugacaaaauugaggcaaaaa

SEQ ID NO: 1798 - RNA, 25 nt, Artificial Sequence
  Synthetic Oligonucleotide
uuaugacaaaauugaggcaaaaaaa

SEQ ID NO: 1799 - RNA, 25 nt, Artificial Sequence
  Synthetic Oligonucleotide
augacaaaauugaggcaaaaaaaug

SEQ ID NO: 1800 - RNA, 25 nt, Artificial Sequence
  Synthetic Oligonucleotide
aauggcaagagagaaaagaggcccu

SEQ ID NO: 1801 - RNA, 25 nt, Artificial Sequence
  Synthetic Oligonucleotide
agguuguuggaaaggacaccaaugu

SEQ ID NO: 1802 - RNA, 25 nt, Artificial Sequence
  Synthetic Oligonucleotide
guuguuggaaaggacaccaauguca

SEQ ID NO: 1803 - RNA, 25 nt, Artificial Sequence
  Synthetic Oligonucleotide
uguuggaaaggacaccaaugucaug

SEQ ID NO: 1804 - RNA, 25 nt, Artificial Sequence
  Synthetic Oligonucleotide
uuggaaaggacaccaaugucauguu

SEQ ID NO: 1805 - RNA, 25 nt, Artificial Sequence
  Synthetic Oligonucleotide
ggaaaggacaccaaugucauguugg

SEQ ID NO: 1806 - RNA, 25 nt, Artificial Sequence
  Synthetic Oligonucleotide
aaaggacaccaaugucauguuggug

SEQ ID NO: 1807 - RNA, 25 nt, Artificial Sequence
  Synthetic Oligonucleotide
aggacaccaaugucauguugguggc

SEQ ID NO: 1808 - RNA, 25 nt, Artificial Sequence
  Synthetic Oligonucleotide
gacaccaaugucauguugguggcuu

SEQ ID NO: 1809 - RNA, 25 nt, Artificial Sequence
  Synthetic Oligonucleotide
gcuuuggcagcaaaaugucuuacug

SEQ ID NO: 1810 - RNA, 25 nt, Artificial Sequence
  Synthetic Oligonucleotide
uuuggcagcaaaaugucuuacuggc

SEQ ID NO: 1811 - RNA, 25 nt, Artificial Sequence
  Synthetic Oligonucleotide
uggcagcaaaaugucuuacuggccu

SEQ ID NO: 1812 - RNA, 25 nt, Artificial Sequence
  Synthetic Oligonucleotide
gcagcaaaaugucuuacuggccugg

SEQ ID NO: 1813 - RNA, 25 nt, Artificial Sequence
  Synthetic Oligonucleotide
agcaaaaugucuuacuggccuggcu

SEQ ID NO: 1814 - RNA, 25 nt, Artificial Sequence
  Synthetic Oligonucleotide
agaaauuuggacaauaugcaggaca

SEQ ID NO: 1815 - RNA, 25 nt, Artificial Sequence
  Synthetic Oligonucleotide
aaauuuggacaauaugcaggacaug

SEQ ID NO: 1816 - RNA, 25 nt, Artificial Sequence
  Synthetic Oligonucleotide
auuuggacaauaugcaggacauguu

SEQ ID NO: 1817 - RNA, 25 nt, Artificial Sequence
  Synthetic Oligonucleotide
uuggacaauaugcaggacauguugu

SEQ ID NO: 1818 - RNA, 25 nt, Artificial Sequence
  Synthetic Oligonucleotide
ggacaauaugcaggacauguugugc

SEQ ID NO: 1819 - RNA, 25 nt, Artificial Sequence
  Synthetic Oligonucleotide
acaauaugcaggacauguugugcca

SEQ ID NO: 1820 - RNA, 25 nt, Artificial Sequence
  Synthetic Oligonucleotide
aauaugcaggacauguugugccaac

SEQ ID NO: 1821 - RNA, 25 nt, Artificial Sequence
  Synthetic Oligonucleotide
uaugcaggacauguugugccaacca

SEQ ID NO: 1822 - RNA, 25 nt, Artificial Sequence
  Synthetic Oligonucleotide
ugcaggacauguugugccaaccauc

SEQ ID NO: 1823 - RNA, 25 nt, Artificial Sequence
  Synthetic Oligonucleotide
caggacauguugugccaaccaucuu

SEQ ID NO: 1824 - RNA, 25 nt, Artificial Sequence
  Synthetic Oligonucleotide
cucaagugguacaagcccugcagga

SEQ ID NO: 1825 - RNA, 25 nt, Artificial Sequence
  Synthetic Oligonucleotide
caagugguacaagcccugcaggagg

SEQ ID NO: 1826 - RNA, 25 nt, Artificial Sequence
  Synthetic Oligonucleotide
agugguacaagcccugcaggaggca

SEQ ID NO: 1827 - RNA, 25 nt, Artificial Sequence
  Synthetic Oligonucleotide
ugguacaagcccugcaggaggcaau

SEQ ID NO: 1828 - RNA, 25 nt, Artificial Sequence
  Synthetic Oligonucleotide
guacaagcccugcaggaggcaauug

SEQ ID NO: 1829 - RNA, 25 nt, Artificial Sequence
  Synthetic Oligonucleotide
acaagcccugcaggaggcaauugau

SEQ ID NO: 1830 - RNA, 25 nt, Artificial Sequence
  Synthetic Oligonucleotide
aagcccugcaggaggcaauugaugc

SEQ ID NO: 1831 - RNA, 25 nt, Artificial Sequence
  Synthetic Oligonucleotide
gcccugcaggaggcaauugaugcaa

SEQ ID NO: 1832 - RNA, 25 nt, Artificial Sequence
  Synthetic Oligonucleotide
ccugcaggaggcaauugaugcaauc

SEQ ID NO: 1833 - RNA, 25 nt, Artificial Sequence
  Synthetic Oligonucleotide
ugcaggaggcaauugaugcaaucuu

SEQ ID NO: 1834 - RNA, 25 nt, Artificial Sequence
  Synthetic Oligonucleotide
caggaggcaauugaugcaaucuucc

SEQ ID NO: 1835 - RNA, 25 nt, Artificial Sequence
  Synthetic Oligonucleotide
ggaggcaauugaugcaaucuuccuu

SEQ ID NO: 1836 - RNA, 25 nt, Artificial Sequence
  Synthetic Oligonucleotide
aggcaauugaugcaaucuuccuuac

SEQ ID NO: 1837 - RNA, 25 nt, Artificial Sequence
  Synthetic Oligonucleotide
gcaauugaugcaaucuuccuuacua

SEQ ID NO: 1838 - RNA, 25 nt, Artificial Sequence
  Synthetic Oligonucleotide
acuaccacacuacagaacaucagug

SEQ ID NO: 1839 - RNA, 25 nt, Artificial Sequence
  Synthetic Oligonucleotide
uaccacacuacagaacaucagugag

SEQ ID NO: 1840 - RNA, 25 nt, Artificial Sequence
  Synthetic Oligonucleotide
ccacacuacagaacaucagugagga

SEQ ID NO: 1841 - RNA, 25 nt, Artificial Sequence
  Synthetic Oligonucleotide
acacuacagaacaucagugaggaug

SEQ ID NO: 1842 - RNA, 25 nt, Artificial Sequence
  Synthetic Oligonucleotide
acuacagaacaucagugaggauguu

SEQ ID NO: 1843 - RNA, 25 nt, Artificial Sequence
  Synthetic Oligonucleotide
uacagaacaucagugaggauguuuu

SEQ ID NO: 1844 - RNA, 25 nt, Artificial Sequence
  Synthetic Oligonucleotide
cagaacaucagugaggauguuuuag

SEQ ID NO: 1845 - RNA, 25 nt, Artificial Sequence
  Synthetic Oligonucleotide
uuagcaguaauggauaauaaaaauc

SEQ ID NO: 1846 - RNA, 25 nt, Artificial Sequence
  Synthetic Oligonucleotide
agcaguaauggauaauaaaaaucca

SEQ ID NO: 1847 - RNA, 25 nt, Artificial Sequence
  Synthetic Oligonucleotide
caguaauggauaauaaaaauccaac

SEQ ID NO: 1848 - RNA, 25 nt, Artificial Sequence
  Synthetic Oligonucleotide
guaauggauaauaaaaauccaacca

SEQ ID NO: 1849 - RNA, 25 nt, Artificial Sequence
  Synthetic Oligonucleotide
accaucaagcagcagacaucucuuu

SEQ ID NO: 1850 - RNA, 25 nt, Artificial Sequence
  Synthetic Oligonucleotide
cuacuuaagcacaucaaugauucug

SEQ ID NO: 1851 - RNA, 25 nt, Artificial Sequence
  Synthetic Oligonucleotide
acuuaagcacaucaaugauucugcu

SEQ ID NO: 1852 - RNA, 25 nt, Artificial Sequence
  Synthetic Oligonucleotide
uuaagcacaucaaugauucugcucc

SEQ ID NO: 1853 - RNA, 25 nt, Artificial Sequence
  Synthetic Oligonucleotide
aagcacaucaaugauucugcuccug

SEQ ID NO: 1854 - RNA, 25 nt, Artificial Sequence
  Synthetic Oligonucleotide
gcacaucaaugauucugcuccugaa

SEQ ID NO: 1855 - RNA, 25 nt, Artificial Sequence
  Synthetic Oligonucleotide
acaucaaugauucugcuccugaagu

SEQ ID NO: 1856 - RNA, 25 nt, Artificial Sequence
  Synthetic Oligonucleotide
aucaaugauucugcuccugaaguca

SEQ ID NO: 1857 - RNA, 25 nt, Artificial Sequence
  Synthetic Oligonucleotide
caaugauucugcuccugaagucaga

SEQ ID NO: 1858 - RNA, 25 nt, Artificial Sequence
  Synthetic Oligonucleotide
augauucugcuccugaagucagaga

SEQ ID NO: 1859 - RNA, 25 nt, Artificial Sequence
  Synthetic Oligonucleotide
gauucugcuccugaagucagagaug

SEQ ID NO: 1860 - RNA, 25 nt, Artificial Sequence
  Synthetic Oligonucleotide
uucugcuccugaagucagagaugcc

SEQ ID NO: 1861 - RNA, 25 nt, Artificial Sequence
  Synthetic Oligonucleotide
cugcuccugaagucagagaugccgc

SEQ ID NO: 1862 - RNA, 25 nt, Artificial Sequence
  Synthetic Oligonucleotide
gcuccugaagucagagaugccgcau

SEQ ID NO: 1863 - RNA, 25 nt, Artificial Sequence
  Synthetic Oligonucleotide
gaucaaagaauguucagaaaaggua

SEQ ID NO: 1864 - RNA, 25 nt, Artificial Sequence
  Synthetic Oligonucleotide
ucaaagaauguucagaaaagguaga

SEQ ID NO: 1865 - RNA, 25 nt, Artificial Sequence
  Synthetic Oligonucleotide
aaccuggauggaaagaaacuaauuu

SEQ ID NO: 1866 - RNA, 25 nt, Artificial Sequence
  Synthetic Oligonucleotide
ccuggauggaaagaaacuaauuuuc

SEQ ID NO: 1867 - RNA, 25 nt, Artificial Sequence
  Synthetic Oligonucleotide
uggauggaaagaaacuaauuuucag

SEQ ID NO: 1868 - RNA, 25 nt, Artificial Sequence
  Synthetic Oligonucleotide
gauggaaagaaacuaauuuucaggu

SEQ ID NO: 1869 - RNA, 25 nt, Artificial Sequence
  Synthetic Oligonucleotide
uggaaagaaacuaauuuucagguga

SEQ ID NO: 1870 - RNA, 25 nt, Artificial Sequence
  Synthetic Oligonucleotide
gaaagaaacuaauuuucaggugaug

SEQ ID NO: 1871 - RNA, 25 nt, Artificial Sequence
  Synthetic Oligonucleotide
aagaaacuaauuuucaggugaugca

SEQ ID NO: 1872 - RNA, 25 nt, Artificial Sequence
  Synthetic Oligonucleotide
gaaacuaauuuucaggugaugcaaa

SEQ ID NO: 1873 - RNA, 25 nt, Artificial Sequence
  Synthetic Oligonucleotide
aacuaauuuucaggugaugcaaaug

SEQ ID NO: 1874 - RNA, 25 nt, Artificial Sequence
  Synthetic Oligonucleotide
cuaauuuucaggugaugcaaaugaa

SEQ ID NO: 1875 - RNA, 25 nt, Artificial Sequence
  Synthetic Oligonucleotide
uugcuuugauugcccagaagggaaa

SEQ ID NO: 1876 - RNA, 25 nt, Artificial Sequence
  Synthetic Oligonucleotide
gcuuugauugcccagaagggaaauu

SEQ ID NO: 1877 - RNA, 25 nt, Artificial Sequence
  Synthetic Oligonucleotide
uuugauugcccagaagggaaauuuu

SEQ ID NO: 1878 - RNA, 25 nt, Artificial Sequence
  Synthetic Oligonucleotide
ugauugcccagaagggaaauuuuuc

SEQ ID NO: 1879 - RNA, 25 nt, Artificial Sequence
  Synthetic Oligonucleotide
auugcccagaagggaaauuuuucca

SEQ ID NO: 1880 - RNA, 25 nt, Artificial Sequence
  Synthetic Oligonucleotide
ugcccagaagggaaauuuuuccaaa

SEQ ID NO: 1881 - RNA, 25 nt, Artificial Sequence
  Synthetic Oligonucleotide
cccagaagggaaauuuuuccaaaac

SEQ ID NO: 1882 - RNA, 25 nt, Artificial Sequence
  Synthetic Oligonucleotide
gacaagauuggagaugugaaaugug

SEQ ID NO: 1883 - RNA, 25 nt, Artificial Sequence
  Synthetic Oligonucleotide
caagauuggagaugugaaauguggg

SEQ ID NO: 1884 - RNA, 25 nt, Artificial Sequence
  Synthetic Oligonucleotide
agauuggagaugugaaaugugggaa

SEQ ID NO: 1885 - RNA, 25 nt, Artificial Sequence
  Synthetic Oligonucleotide
auuggagaugugaaaugugggaaca

SEQ ID NO: 1886 - RNA, 25 nt, Artificial Sequence
  Synthetic Oligonucleotide
uggagaugugaaaugugggaacaau

SEQ ID NO: 1887 - RNA, 25 nt, Artificial Sequence
  Synthetic Oligonucleotide
gagaugugaaaugugggaacaaugc

SEQ ID NO: 1888 - RNA, 25 nt, Artificial Sequence
  Synthetic Oligonucleotide
gaugugaaaugugggaacaaugcaa

SEQ ID NO: 1889 - RNA, 25 nt, Artificial Sequence
  Synthetic Oligonucleotide
ugugaaaugugggaacaaugcaaaa

SEQ ID NO: 1890 - RNA, 25 nt, Artificial Sequence
  Synthetic Oligonucleotide
ugaaaugugggaacaaugcaaaaga

SEQ ID NO: 1891 - RNA, 25 nt, Artificial Sequence
  Synthetic Oligonucleotide
aaaugugggaacaaugcaaaagaag

SEQ ID NO: 1892 - RNA, 25 nt, Artificial Sequence
  Synthetic Oligonucleotide
augugggaacaaugcaaaagaagcu

SEQ ID NO: 1893 - RNA, 25 nt, Artificial Sequence
  Synthetic Oligonucleotide
gugggaacaaugcaaaagaagcuau

SEQ ID NO: 1894 - RNA, 25 nt, Artificial Sequence
  Synthetic Oligonucleotide
gggaacaaugcaaaagaagcuauga

SEQ ID NO: 1895 - RNA, 25 nt, Artificial Sequence
  Synthetic Oligonucleotide
guugaaugucaaagcuuucauuagc

SEQ ID NO: 1896 - RNA, 25 nt, Artificial Sequence
  Synthetic Oligonucleotide
ugaaugucaaagcuuucauuagcaa

SEQ ID NO: 1897 - RNA, 25 nt, Artificial Sequence
  Synthetic Oligonucleotide
aaugucaaagcuuucauuagcaaug

SEQ ID NO: 1898 - RNA, 25 nt, Artificial Sequence
  Synthetic Oligonucleotide
ugucaaagcuuucauuagcaaugug

SEQ ID NO: 1899 - RNA, 25 nt, Artificial Sequence
  Synthetic Oligonucleotide
ucaaagcuuucauuagcaaugugaa

SEQ ID NO: 1900 - RNA, 25 nt, Artificial Sequence
  Synthetic Oligonucleotide
cccugcuuggcgugauguaucugua

SEQ ID NO: 1901 - RNA, 25 nt, Artificial Sequence
  Synthetic Oligonucleotide
cugcuuggcgugauguaucuguaug

SEQ ID NO: 1902 - RNA, 25 nt, Artificial Sequence
  Synthetic Oligonucleotide
ucuuugaggaugagaagccugcccu

SEQ ID NO: 1903 - RNA, 25 nt, Artificial Sequence
  Synthetic Oligonucleotide
uuugaggaugagaagccugcccucc

SEQ ID NO: 1904 - RNA, 25 nt, Artificial Sequence
  Synthetic Oligonucleotide
ugaggaugagaagccugcccuccua

SEQ ID NO: 1905 - RNA, 25 nt, Artificial Sequence
  Synthetic Oligonucleotide
aggaugagaagccugcccuccuauc

SEQ ID NO: 1906 - RNA, 25 nt, Artificial Sequence
  Synthetic Oligonucleotide
gaugagaagccugcccuccuauccc

SEQ ID NO: 1907 - RNA, 25 nt, Artificial Sequence
  Synthetic Oligonucleotide
ugagaagccugcccuccuaucccag

SEQ ID NO: 1908 - RNA, 25 nt, Artificial Sequence
  Synthetic Oligonucleotide
agaagccugcccuccuaucccagau

SEQ ID NO: 1909 - RNA, 25 nt, Artificial Sequence
  Synthetic Oligonucleotide
aagccugcccuccuaucccagauag

SEQ ID NO: 1910 - RNA, 25 nt, Artificial Sequence
  Synthetic Oligonucleotide
gccugcccuccuaucccagauagau

SEQ ID NO: 1911 - RNA, 25 nt, Artificial Sequence
  Synthetic Oligonucleotide
cugcccuccuaucccagauagaugc

SEQ ID NO: 1912 - RNA, 25 nt, Artificial Sequence
  Synthetic Oligonucleotide
gcccuccuaucccagauagaugcag

SEQ ID NO: 1913 - RNA, 25 nt, Artificial Sequence
  Synthetic Oligonucleotide
ccuccuaucccagauagaugcagaa

SEQ ID NO: 1914 - RNA, 25 nt, Artificial Sequence
  Synthetic Oligonucleotide
uccuaucccagauagaugcagaauu

SEQ ID NO: 1915 - RNA, 25 nt, Artificial Sequence
  Synthetic Oligonucleotide
cuaucccagauagaugcagaauuug

SEQ ID NO: 1916 - RNA, 25 nt, Artificial Sequence
  Synthetic Oligonucleotide
aucccagauagaugcagaauuugag

SEQ ID NO: 1917 - RNA, 25 nt, Artificial Sequence
  Synthetic Oligonucleotide
cccagauagaugcagaauuugagaa

SEQ ID NO: 1918 - RNA, 25 nt, Artificial Sequence
  Synthetic Oligonucleotide
aagaugcagggacaaaguccaccug

SEQ ID NO: 1919 - RNA, 25 nt, Artificial Sequence
  Synthetic Oligonucleotide
uacagaugaaggagaagauggagau

SEQ ID NO: 1920 - RNA, 25 nt, Artificial Sequence
  Synthetic Oligonucleotide
cagaugaaggagaagauggagauga

SEQ ID NO: 1921 - RNA, 25 nt, Artificial Sequence
  Synthetic Oligonucleotide
gaugaaggagaagauggagaugaac

SEQ ID NO: 1922 - RNA, 25 nt, Artificial Sequence
  Synthetic Oligonucleotide
guugaucuuuugccgaggacggaga

SEQ ID NO: 1923 - RNA, 25 nt, Artificial Sequence
  Synthetic Oligonucleotide
ggaaagaaggccuagaugaaguggc

SEQ ID NO: 1924 - RNA, 25 nt, Artificial Sequence
  Synthetic Oligonucleotide
aaagaaggccuagaugaaguggcag

SEQ ID NO: 1925 - RNA, 25 nt, Artificial Sequence
  Synthetic Oligonucleotide
agaaggccuagaugaaguggcaggu

SEQ ID NO: 1926 - RNA, 25 nt, Artificial Sequence
  Synthetic Oligonucleotide
aaggccuagaugaaguggcagguau

SEQ ID NO: 1927 - RNA, 25 nt, Artificial Sequence
  Synthetic Oligonucleotide
ggccuagaugaaguggcagguauua

SEQ ID NO: 1928 - RNA, 25 nt, Artificial Sequence
  Synthetic Oligonucleotide
ccuagaugaaguggcagguauuauu

SEQ ID NO: 1929 - RNA, 25 nt, Artificial Sequence
  Synthetic Oligonucleotide
uagaugaaguggcagguauuauuaa

SEQ ID NO: 1930 - RNA, 25 nt, Artificial Sequence
  Synthetic Oligonucleotide
gaugaaguggcagguauuauuaaug

SEQ ID NO: 1931 - RNA, 25 nt, Artificial Sequence
  Synthetic Oligonucleotide
aauauaggugaacuuccaacugccu

SEQ ID NO: 1932 - RNA, 25 nt, Artificial Sequence
  Synthetic Oligonucleotide
uauaggugaacuuccaacugccuug

SEQ ID NO: 1933 - RNA, 25 nt, Artificial Sequence
  Synthetic Oligonucleotide
uaggugaacuuccaacugccuugaa

SEQ ID NO: 1934 - RNA, 25 nt, Artificial Sequence
  Synthetic Oligonucleotide
ggugaacuuccaacugccuugaagg

SEQ ID NO: 1935 - RNA, 25 nt, Artificial Sequence
  Synthetic Oligonucleotide
ugaacuuccaacugccuugaagggu

SEQ ID NO: 1936 - RNA, 25 nt, Artificial Sequence
  Synthetic Oligonucleotide
aacuuccaacugccuugaagggucg

SEQ ID NO: 1937 - RNA, 25 nt, Artificial Sequence
  Synthetic Oligonucleotide
cuuccaacugccuugaagggucgac

SEQ ID NO: 1938 - RNA, 25 nt, Artificial Sequence
  Synthetic Oligonucleotide
uccaacugccuugaagggucgacuc

SEQ ID NO: 1939 - RNA, 25 nt, Artificial Sequence
  Synthetic Oligonucleotide
caacugccuugaagggucgacucaa

SEQ ID NO: 1940 - RNA, 25 nt, Artificial Sequence
  Synthetic Oligonucleotide
acugccuugaagggucgacucaaug

SEQ ID NO: 1941 - RNA, 25 nt, Artificial Sequence
  Synthetic Oligonucleotide
caacuggcaguagccaugggcccaa

SEQ ID NO: 1942 - RNA, 25 nt, Artificial Sequence
  Synthetic Oligonucleotide
agcaagaacaauguucgagcugcug

SEQ ID NO: 1943 - RNA, 25 nt, Artificial Sequence
  Synthetic Oligonucleotide
caagaacaauguucgagcugcugcc

SEQ ID NO: 1944 - RNA, 25 nt, Artificial Sequence
  Synthetic Oligonucleotide
agaacaauguucgagcugcugcccu

SEQ ID NO: 1945 - RNA, 25 nt, Artificial Sequence
  Synthetic Oligonucleotide
aacaauguucgagcugcugcccuag

SEQ ID NO: 1946 - RNA, 25 nt, Artificial Sequence
  Synthetic Oligonucleotide
caauguucgagcugcugcccuagcg

SEQ ID NO: 1947 - RNA, 25 nt, Artificial Sequence
  Synthetic Oligonucleotide
auguucgagcugcugcccuagcgac

SEQ ID NO: 1948 - RNA, 25 nt, Artificial Sequence
  Synthetic Oligonucleotide
guucgagcugcugcccuagcgacug

SEQ ID NO: 1949 - RNA, 25 nt, Artificial Sequence
  Synthetic Oligonucleotide
acugugaaugcuugggcagaacaga

SEQ ID NO: 1950 - RNA, 25 nt, Artificial Sequence
  Synthetic Oligonucleotide
ugugaaugcuugggcagaacagacu

SEQ ID NO: 1951 - RNA, 25 nt, Artificial Sequence
  Synthetic Oligonucleotide
ugaaugcuugggcagaacagacugg

SEQ ID NO: 1952 - RNA, 25 nt, Artificial Sequence
  Synthetic Oligonucleotide
gagaagaucuuucugaagagcucaa

SEQ ID NO: 1953 - RNA, 25 nt, Artificial Sequence
  Synthetic Oligonucleotide
cuagaagaucgaaauggagaugugc

SEQ ID NO: 1954 - RNA, 25 nt, Artificial Sequence
  Synthetic Oligonucleotide
agaagaucgaaauggagaugugcga

SEQ ID NO: 1955 - RNA, 25 nt, Artificial Sequence
  Synthetic Oligonucleotide
aagaucgaaauggagaugugcgaaa

SEQ ID NO: 1956 - RNA, 25 nt, Artificial Sequence
  Synthetic Oligonucleotide
ugaugcauuuaggauaugaaaaaau

SEQ ID NO: 1957 - RNA, 25 nt, Artificial Sequence
  Synthetic Oligonucleotide
augcauuuaggauaugaaaaaaugg

SEQ ID NO: 1958 - RNA, 25 nt, Artificial Sequence
  Synthetic Oligonucleotide
gcauuuaggauaugaaaaaauggcc

SEQ ID NO: 1959 - RNA, 25 nt, Artificial Sequence
  Synthetic Oligonucleotide
auuuaggauaugaaaaaauggccaa

SEQ ID NO: 1960 - RNA, 25 nt, Artificial Sequence
  Synthetic Oligonucleotide
uuaggauaugaaaaaauggccaagg

SEQ ID NO: 1961 - RNA, 25 nt, Artificial Sequence
  Synthetic Oligonucleotide
aaggcuacugggaaacuaaagccaa

SEQ ID NO: 1962 - RNA, 25 nt, Artificial Sequence
  Synthetic Oligonucleotide
ggcuacugggaaacuaaagccaacu

SEQ ID NO: 1963 - RNA, 25 nt, Artificial Sequence
  Synthetic Oligonucleotide
cuacugggaaacuaaagccaacuuc

SEQ ID NO: 1964 - RNA, 25 nt, Artificial Sequence
  Synthetic Oligonucleotide
acugggaaacuaaagccaacuucua

SEQ ID NO: 1965 - RNA, 25 nt, Artificial Sequence
  Synthetic Oligonucleotide
ugggaaacuaaagccaacuucuaaa

SEQ ID NO: 1966 - RNA, 25 nt, Artificial Sequence
  Synthetic Oligonucleotide
ggaaacuaaagccaacuucuaaaga

SEQ ID NO: 1967 - RNA, 25 nt, Artificial Sequence
  Synthetic Oligonucleotide
aaacuaaagccaacuucuaaagauc

SEQ ID NO: 1968 - RNA, 25 nt, Artificial Sequence
  Synthetic Oligonucleotide
acuaaagccaacuucuaaagaucag

SEQ ID NO: 1969 - RNA, 25 nt, Artificial Sequence
  Synthetic Oligonucleotide
uaaagccaacuucuaaagaucaggu

SEQ ID NO: 1970 - RNA, 25 nt, Artificial Sequence
  Synthetic Oligonucleotide
aagccaacuucuaaagaucagguau

SEQ ID NO: 1971 - RNA, 25 nt, Artificial Sequence
  Synthetic Oligonucleotide
ccuauuuuuauuguuguuccaaaug

SEQ ID NO: 1972 - RNA, 25 nt, Artificial Sequence
  Synthetic Oligonucleotide
uauuuuuauuguuguuccaaaugga

SEQ ID NO: 1973 - RNA, 25 nt, Artificial Sequence
  Synthetic Oligonucleotide
uuuuuauuguuguuccaaauggaaa

SEQ ID NO: 1974 - RNA, 25 nt, Artificial Sequence
  Synthetic Oligonucleotide
uuuauuguuguuccaaauggaaaag

SEQ ID NO: 1975 - RNA, 25 nt, Artificial Sequence
  Synthetic Oligonucleotide
uauuguuguuccaaauggaaaagag

SEQ ID NO: 1976 - RNA, 25 nt, Artificial Sequence
  Synthetic Oligonucleotide
uuguuguuccaaauggaaaagagca

SEQ ID NO: 1977 - RNA, 25 nt, Artificial Sequence
  Synthetic Oligonucleotide
aggugcuaaaguggaauuuuacuac

SEQ ID NO: 1978 - RNA, 25 nt, Artificial Sequence
  Synthetic Oligonucleotide
gugcuaaaguggaauuuuacuaccc

SEQ ID NO: 1979 - RNA, 25 nt, Artificial Sequence
  Synthetic Oligonucleotide
aucaucuuacugagaaugaagcauc

SEQ ID NO: 1980 - RNA, 25 nt, Artificial Sequence
  Synthetic Oligonucleotide
caucuuacugagaaugaagcaucuu

SEQ ID NO: 1981 - RNA, 25 nt, Artificial Sequence
  Synthetic Oligonucleotide
ucuuacugagaaugaagcaucuucc

SEQ ID NO: 1982 - RNA, 25 nt, Artificial Sequence
  Synthetic Oligonucleotide
uuacugagaaugaagcaucuuccuu

SEQ ID NO: 1983 - RNA, 25 nt, Artificial Sequence
  Synthetic Oligonucleotide
caagguuggagaaccaaaggauguc

SEQ ID NO: 1984 - RNA, 25 nt, Artificial Sequence
  Synthetic Oligonucleotide
agguuggagaaccaaaggaugucau

SEQ ID NO: 1985 - RNA, 25 nt, Artificial Sequence
  Synthetic Oligonucleotide
guuggagaaccaaaggaugucauuc

SEQ ID NO: 1986 - RNA, 25 nt, Artificial Sequence
  Synthetic Oligonucleotide
uggagaaccaaaggaugucauucgu

SEQ ID NO: 1987 - RNA, 25 nt, Artificial Sequence
  Synthetic Oligonucleotide
gagaaccaaaggaugucauucguaa

SEQ ID NO: 1988 - RNA, 25 nt, Artificial Sequence
  Synthetic Oligonucleotide
gaaccaaaggaugucauucguaaag

SEQ ID NO: 1989 - RNA, 25 nt, Artificial Sequence
  Synthetic Oligonucleotide
accaaaggaugucauucguaaagau

SEQ ID NO: 1990 - RNA, 25 nt, Artificial Sequence
  Synthetic Oligonucleotide
caaaggaugucauucguaaagaugu

SEQ ID NO: 1991 - RNA, 25 nt, Artificial Sequence
  Synthetic Oligonucleotide
aaggaugucauucguaaagauguuc

SEQ ID NO: 1992 - RNA, 25 nt, Artificial Sequence
  Synthetic Oligonucleotide
ggaugucauucguaaagauguucgu

SEQ ID NO: 1993 - RNA, 25 nt, Artificial Sequence
  Synthetic Oligonucleotide
augucauucguaaagauguucgugc

SEQ ID NO: 1994 - RNA, 25 nt, Artificial Sequence
  Synthetic Oligonucleotide
uccugaaccggaugugccuugucua

SEQ ID NO: 1995 - RNA, 25 nt, Artificial Sequence
  Synthetic Oligonucleotide
cugaaccggaugugccuugucuacc

SEQ ID NO: 1996 - RNA, 25 nt, Artificial Sequence
  Synthetic Oligonucleotide
gaaccggaugugccuugucuaccca

SEQ ID NO: 1997 - RNA, 25 nt, Artificial Sequence
  Synthetic Oligonucleotide
accggaugugccuugucuacccagc

SEQ ID NO: 1998 - RNA, 25 nt, Artificial Sequence
  Synthetic Oligonucleotide
cggaugugccuugucuacccagcua

SEQ ID NO: 1999 - RNA, 25 nt, Artificial Sequence
  Synthetic Oligonucleotide
gaugugccuugucuacccagcuagc

SEQ ID NO: 2000 - RNA, 25 nt, Artificial Sequence
  Synthetic Oligonucleotide
ugugccuugucuacccagcuagcaa

SEQ ID NO: 2001 - RNA, 25 nt, Artificial Sequence
  Synthetic Oligonucleotide
ccaaaaacucuaagcagagagcaga

SEQ ID NO: 2002 - RNA, 25 nt, Artificial Sequence
  Synthetic Oligonucleotide
aaaaacucuaagcagagagcagagu

SEQ ID NO: 2003 - RNA, 25 nt, Artificial Sequence
  Synthetic Oligonucleotide
aaacucuaagcagagagcagagugc

SEQ ID NO: 2004 - RNA, 25 nt, Artificial Sequence
  Synthetic Oligonucleotide
acucuaagcagagagcagagugccu

SEQ ID NO: 2005 - RNA, 25 nt, Artificial Sequence
  Synthetic Oligonucleotide
ucuaagcagagagcagagugccugg

SEQ ID NO: 2006 - RNA, 25 nt, Artificial Sequence
  Synthetic Oligonucleotide
uaagcagagagcagagugccuggaa

SEQ ID NO: 2007 - RNA, 25 nt, Artificial Sequence
  Synthetic Oligonucleotide
agcagagagcagagugccuggaaga

SEQ ID NO: 2008 - RNA, 25 nt, Artificial Sequence
  Synthetic Oligonucleotide
cagagagcagagugccuggaagagc

SEQ ID NO: 2009 - RNA, 25 nt, Artificial Sequence
  Synthetic Oligonucleotide
gagagcagagugccuggaagagcug

SEQ ID NO: 2010 - RNA, 25 nt, Artificial Sequence
  Synthetic Oligonucleotide
gagcagagugccuggaagagcuggg

SEQ ID NO: 2011 - RNA, 25 nt, Artificial Sequence
  Synthetic Oligonucleotide
gcagagugccuggaagagcugggau

SEQ ID NO: 2012 - RNA, 25 nt, Artificial Sequence
  Synthetic Oligonucleotide
caggaaaagccuuaaaggaaauagc

SEQ ID NO: 2013 - RNA, 25 nt, Artificial Sequence
  Synthetic Oligonucleotide
aucagguguucaaacugauuggaaa

SEQ ID NO: 2014 - RNA, 25 nt, Artificial Sequence
  Synthetic Oligonucleotide
cagguguucaaacugauuggaaauc

SEQ ID NO: 2015 - RNA, 25 nt, Artificial Sequence
  Synthetic Oligonucleotide
gguguucaaacugauuggaaaucuu

SEQ ID NO: 2016 - RNA, 25 nt, Artificial Sequence
  Synthetic Oligonucleotide
uguucaaacugauuggaaaucuuuc

SEQ ID NO: 2017 - RNA, 25 nt, Artificial Sequence
  Synthetic Oligonucleotide
uucaaacugauuggaaaucuuucug

SEQ ID NO: 2018 - RNA, 25 nt, Artificial Sequence
  Synthetic Oligonucleotide
caaacugauuggaaaucuuucugaa

SEQ ID NO: 2019 - RNA, 25 nt, Artificial Sequence
  Synthetic Oligonucleotide
aacugauuggaaaucuuucugaaaa

SEQ ID NO: 2020 - RNA, 25 nt, Artificial Sequence
  Synthetic Oligonucleotide
cugauuggaaaucuuucugaaaagg

SEQ ID NO: 2021 - RNA, 25 nt, Artificial Sequence
  Synthetic Oligonucleotide
aagcggucagcaaagagacccucug

SEQ ID NO: 2022 - RNA, 25 nt, Artificial Sequence
  Synthetic Oligonucleotide
gcggucagcaaagagacccucugcu

SEQ ID NO: 2023 - RNA, 25 nt, Artificial Sequence
  Synthetic Oligonucleotide
ggucagcaaagagacccucugcugc

SEQ ID NO: 2024 - RNA, 25 nt, Artificial Sequence
  Synthetic Oligonucleotide
ucagcaaagagacccucugcugcac

SEQ ID NO: 2025 - RNA, 25 nt, Artificial Sequence
  Synthetic Oligonucleotide
agcaaagagacccucugcugcacca

SEQ ID NO: 2026 - RNA, 25 nt, Artificial Sequence
  Synthetic Oligonucleotide
caaagagacccucugcugcaccaau

SEQ ID NO: 2027 - RNA, 25 nt, Artificial Sequence
  Synthetic Oligonucleotide
aagagacccucugcugcaccaauaa

SEQ ID NO: 2028 - RNA, 25 nt, Artificial Sequence
  Synthetic Oligonucleotide
uacgcaagggaccagcugaggacau

SEQ ID NO: 2029 - RNA, 25 nt, Artificial Sequence
  Synthetic Oligonucleotide
cgcaagggaccagcugaggacaugu

SEQ ID NO: 2030 - RNA, 25 nt, Artificial Sequence
  Synthetic Oligonucleotide
cgccgagaauuccagcuggaucuag

SEQ ID NO: 2031 - RNA, 25 nt, Artificial Sequence
  Synthetic Oligonucleotide
ccgagaauuccagcuggaucuagau

SEQ ID NO: 2032 - RNA, 25 nt, Artificial Sequence
  Synthetic Oligonucleotide
agauccgggcuguuucuccacacuu

SEQ ID NO: 2033 - RNA, 25 nt, Artificial Sequence
  Synthetic Oligonucleotide
auccgggcuguuucuccacacuucg

SEQ ID NO: 2034 - RNA, 25 nt, Artificial Sequence
  Synthetic Oligonucleotide
gaugacaugcacaguaauacagcau

SEQ ID NO: 2035 - RNA, 25 nt, Artificial Sequence
  Synthetic Oligonucleotide
ugacaugcacaguaauacagcaucc

SEQ ID NO: 2036 - RNA, 25 nt, Artificial Sequence
  Synthetic Oligonucleotide
acaugcacaguaauacagcauccac

SEQ ID NO: 2037 - RNA, 25 nt, Artificial Sequence
  Synthetic Oligonucleotide
augcacaguaauacagcauccacaa

SEQ ID NO: 2038 - RNA, 25 nt, Artificial Sequence
  Synthetic Oligonucleotide
gcacaguaauacagcauccacaauc

SEQ ID NO: 2039 - RNA, 25 nt, Artificial Sequence
  Synthetic Oligonucleotide
acaguaauacagcauccacaaucaa

SEQ ID NO: 2040 - RNA, 25 nt, Artificial Sequence
  Synthetic Oligonucleotide
aguaauacagcauccacaaucaauu

SEQ ID NO: 2041 - RNA, 25 nt, Artificial Sequence
  Synthetic Oligonucleotide
uaauacagcauccacaaucaauuuc

SEQ ID NO: 2042 - RNA, 25 nt, Artificial Sequence
  Synthetic Oligonucleotide
auacagcauccacaaucaauuucau

SEQ ID NO: 2043 - RNA, 25 nt, Artificial Sequence
  Synthetic Oligonucleotide
acagcauccacaaucaauuucauua

SEQ ID NO: 2044 - RNA, 25 nt, Artificial Sequence
  Synthetic Oligonucleotide
agcauccacaaucaauuucauuauc

SEQ ID NO: 2045 - RNA, 25 nt, Artificial Sequence
  Synthetic Oligonucleotide
cauccacaaucaauuucauuaucuc

SEQ ID NO: 2046 - RNA, 25 nt, Artificial Sequence
  Synthetic Oligonucleotide
uccacaaucaauuucauuaucuccc

SEQ ID NO: 2047 - RNA, 25 nt, Artificial Sequence
  Synthetic Oligonucleotide
cacaaucaauuucauuaucucccaa

SEQ ID NO: 2048 - RNA, 25 nt, Artificial Sequence
  Synthetic Oligonucleotide
caaucaauuucauuaucucccaagu

SEQ ID NO: 2049 - RNA, 25 nt, Artificial Sequence
  Synthetic Oligonucleotide
aucaauuucauuaucucccaaguag

SEQ ID NO: 2050 - RNA, 25 nt, Artificial Sequence
  Synthetic Oligonucleotide
caauuucauuaucucccaaguagcc

SEQ ID NO: 2051 - RNA, 25 nt, Artificial Sequence
  Synthetic Oligonucleotide
auuucauuaucucccaaguagccag

SEQ ID NO: 2052 - RNA, 25 nt, Artificial Sequence
  Synthetic Oligonucleotide
uucauuaucucccaaguagccagug

SEQ ID NO: 2053 - RNA, 25 nt, Artificial Sequence
  Synthetic Oligonucleotide
cauuaucucccaaguagccaguggu

SEQ ID NO: 2054 - RNA, 25 nt, Artificial Sequence
  Synthetic Oligonucleotide
uuaucucccaaguagccagugguga

SEQ ID NO: 2055 - RNA, 25 nt, Artificial Sequence
  Synthetic Oligonucleotide
aucucccaaguagccaguggugaca

SEQ ID NO: 2056 - RNA, 25 nt, Artificial Sequence
  Synthetic Oligonucleotide
cucccaaguagccaguggugacauc

SEQ ID NO: 2057 - RNA, 25 nt, Artificial Sequence
  Synthetic Oligonucleotide
cccaaguagccaguggugacaucaa

SEQ ID NO: 2058 - RNA, 25 nt, Artificial Sequence
  Synthetic Oligonucleotide
caaguagccaguggugacaucaaca

SEQ ID NO: 2059 - RNA, 25 nt, Artificial Sequence
  Synthetic Oligonucleotide
gcccgggaggccuccacuggaguac

SEQ ID NO: 2060 - RNA, 25 nt, Artificial Sequence
  Synthetic Oligonucleotide
ccgggaggccuccacuggaguacua

SEQ ID NO: 2061 - RNA, 25 nt, Artificial Sequence
  Synthetic Oligonucleotide
gggaggccuccacuggaguacuaaa

SEQ ID NO: 2062 - RNA, 25 nt, Artificial Sequence
  Synthetic Oligonucleotide
gaggccuccacuggaguacuaaaag

SEQ ID NO: 2063 - RNA, 25 nt, Artificial Sequence
  Synthetic Oligonucleotide
aucaccuuaaugcuggauucucgga

SEQ ID NO: 2064 - RNA, 25 nt, Artificial Sequence
  Synthetic Oligonucleotide
caccuuaaugcuggauucucggauu

SEQ ID NO: 2065 - RNA, 25 nt, Artificial Sequence
  Synthetic Oligonucleotide
ccuuaaugcuggauucucggauuga

SEQ ID NO: 2066 - RNA, 25 nt, Artificial Sequence
  Synthetic Oligonucleotide
uuaaugcuggauucucggauugaag

SEQ ID NO: 2067 - RNA, 25 nt, Artificial Sequence
  Synthetic Oligonucleotide
aaugcuggauucucggauugaagau

SEQ ID NO: 2068 - RNA, 25 nt, Artificial Sequence
  Synthetic Oligonucleotide
ugcuggauucucggauugaagaucu

SEQ ID NO: 2069 - RNA, 25 nt, Artificial Sequence
  Synthetic Oligonucleotide
cuggauucucggauugaagaucuug

SEQ ID NO: 2070 - RNA, 25 nt, Artificial Sequence
  Synthetic Oligonucleotide
ggauucucggauugaagaucuugag

SEQ ID NO: 2071 - RNA, 25 nt, Artificial Sequence
  Synthetic Oligonucleotide
auucucggauugaagaucuugagga

SEQ ID NO: 2072 - RNA, 25 nt, Artificial Sequence
  Synthetic Oligonucleotide
cugugaaccucuugguggugaaggu

SEQ ID NO: 2073 - RNA, 25 nt, Artificial Sequence
  Synthetic Oligonucleotide
gugaaccucuugguggugaagguuc

SEQ ID NO: 2074 - RNA, 25 nt, Artificial Sequence
  Synthetic Oligonucleotide
gaaccucuugguggugaagguucug

SEQ ID NO: 2075 - RNA, 25 nt, Artificial Sequence
  Synthetic Oligonucleotide
accucuugguggugaagguucugga

SEQ ID NO: 2076 - RNA, 25 nt, Artificial Sequence
  Synthetic Oligonucleotide
gacagccugcuagcaacagccaguu

SEQ ID NO: 2077 - RNA, 25 nt, Artificial Sequence
  Synthetic Oligonucleotide
aguucucccaaauucucagagcuug

SEQ ID NO: 2078 - RNA, 25 nt, Artificial Sequence
  Synthetic Oligonucleotide
uucucccaaauucucagagcuuguu

SEQ ID NO: 2079 - RNA, 25 nt, Artificial Sequence
  Synthetic Oligonucleotide
cucccaaauucucagagcuuguuau

SEQ ID NO: 2080 - RNA, 25 nt, Artificial Sequence
  Synthetic Oligonucleotide
cccaaauucucagagcuuguuauga

SEQ ID NO: 2081 - RNA, 25 nt, Artificial Sequence
  Synthetic Oligonucleotide
caaauucucagagcuuguuaugaag

SEQ ID NO: 2082 - RNA, 25 nt, Artificial Sequence
  Synthetic Oligonucleotide
aauucucagagcuuguuaugaagug

SEQ ID NO: 2083 - RNA, 25 nt, Artificial Sequence
  Synthetic Oligonucleotide
uucucagagcuuguuaugaaguguc

SEQ ID NO: 2084 - RNA, 25 nt, Artificial Sequence
  Synthetic Oligonucleotide
cucagagcuuguuaugaagugucuc

SEQ ID NO: 2085 - RNA, 25 nt, Artificial Sequence
  Synthetic Oligonucleotide
cagagcuuguuaugaagugucucug

SEQ ID NO: 2086 - RNA, 25 nt, Artificial Sequence
  Synthetic Oligonucleotide
gagcuuguuaugaagugucucugga

SEQ ID NO: 2087 - RNA, 25 nt, Artificial Sequence
  Synthetic Oligonucleotide
agcauuaaccuagacagaauucuuc

SEQ ID NO: 2088 - RNA, 25 nt, Artificial Sequence
  Synthetic Oligonucleotide
cauuaaccuagacagaauucuucug

SEQ ID NO: 2089 - RNA, 25 nt, Artificial Sequence
  Synthetic Oligonucleotide
uuaaccuagacagaauucuucugga

SEQ ID NO: 2090 - RNA, 25 nt, Artificial Sequence
  Synthetic Oligonucleotide
aaccuagacagaauucuucuggaua

SEQ ID NO: 2091 - RNA, 25 nt, Artificial Sequence
  Synthetic Oligonucleotide
ccuagacagaauucuucuggauauc

SEQ ID NO: 2092 - RNA, 25 nt, Artificial Sequence
  Synthetic Oligonucleotide
uagacagaauucuucuggauaucca

SEQ ID NO: 2093 - RNA, 25 nt, Artificial Sequence
  Synthetic Oligonucleotide
uccacauuuucaugaaggucuuccc

SEQ ID NO: 2094 - RNA, 25 nt, Artificial Sequence
  Synthetic Oligonucleotide
gaagcaaugcaaaagugaauuuccc

SEQ ID NO: 2095 - RNA, 25 nt, Artificial Sequence
  Synthetic Oligonucleotide
agcaaugcaaaagugaauuucccau

SEQ ID NO: 2096 - RNA, 25 nt, Artificial Sequence
  Synthetic Oligonucleotide
caaugcaaaagugaauuucccauaa

SEQ ID NO: 2097 - RNA, 25 nt, Artificial Sequence
  Synthetic Oligonucleotide
aguauggaccagacugggagcaagu

SEQ ID NO: 2098 - RNA, 25 nt, Artificial Sequence
  Synthetic Oligonucleotide
uauggaccagacugggagcaagucu

SEQ ID NO: 2099 - RNA, 25 nt, Artificial Sequence
  Synthetic Oligonucleotide
uggaccagacugggagcaagucuga

SEQ ID NO: 2100 - RNA, 25 nt, Artificial Sequence
  Synthetic Oligonucleotide
gaccagacugggagcaagucugaua

SEQ ID NO: 2101 - RNA, 25 nt, Artificial Sequence
  Synthetic Oligonucleotide
ccagacugggagcaagucugauaag

SEQ ID NO: 2102 - RNA, 25 nt, Artificial Sequence
  Synthetic Oligonucleotide
agacugggagcaagucugauaagga

SEQ ID NO: 2103 - RNA, 25 nt, Artificial Sequence
  Synthetic Oligonucleotide
acugggagcaagucugauaaggaaa

SEQ ID NO: 2104 - RNA, 25 nt, Artificial Sequence
  Synthetic Oligonucleotide
ugggagcaagucugauaaggaaaca

SEQ ID NO: 2105 - RNA, 25 nt, Artificial Sequence
  Synthetic Oligonucleotide
ggagcaagucugauaaggaaacaga

SEQ ID NO: 2106 - RNA, 25 nt, Artificial Sequence
  Synthetic Oligonucleotide
agcaagucugauaaggaaacagaaa

SEQ ID NO: 2107 - RNA, 25 nt, Artificial Sequence
  Synthetic Oligonucleotide
caagucugauaaggaaacagaaaag

SEQ ID NO: 2108 - RNA, 25 nt, Artificial Sequence
  Synthetic Oligonucleotide
agucugauaaggaaacagaaaaggg

SEQ ID NO: 2109 - RNA, 25 nt, Artificial Sequence
  Synthetic Oligonucleotide
ucugauaaggaaacagaaaagggag

SEQ ID NO: 2110 - RNA, 25 nt, Artificial Sequence
  Synthetic Oligonucleotide
ugauaaggaaacagaaaagggagca

SEQ ID NO: 2111 - RNA, 25 nt, Artificial Sequence
  Synthetic Oligonucleotide
auaaggaaacagaaaagggagcauc

SEQ ID NO: 2112 - RNA, 25 nt, Artificial Sequence
  Synthetic Oligonucleotide
aaggaaacagaaaagggagcaucuc

SEQ ID NO: 2113 - RNA, 25 nt, Artificial Sequence
  Synthetic Oligonucleotide
ucucgaauagaugaaaaaucaucaa

SEQ ID NO: 2114 - RNA, 25 nt, Artificial Sequence
  Synthetic Oligonucleotide
ucgaauagaugaaaaaucaucaaag

SEQ ID NO: 2115 - RNA, 25 nt, Artificial Sequence
  Synthetic Oligonucleotide
gaauagaugaaaaaucaucaaaggc

SEQ ID NO: 2116 - RNA, 25 nt, Artificial Sequence
  Synthetic Oligonucleotide
auagaugaaaaaucaucaaaggcca

SEQ ID NO: 2117 - RNA, 25 nt, Artificial Sequence
  Synthetic Oligonucleotide
agaugaaaaaucaucaaaggccaaa

SEQ ID NO: 2118 - RNA, 25 nt, Artificial Sequence
  Synthetic Oligonucleotide
augaaaaaucaucaaaggccaaagu

SEQ ID NO: 2119 - RNA, 25 nt, Artificial Sequence
  Synthetic Oligonucleotide
gaaaaaucaucaaaggccaaaguga

SEQ ID NO: 2120 - RNA, 25 nt, Artificial Sequence
  Synthetic Oligonucleotide
aaaaucaucaaaggccaaagugaau

SEQ ID NO: 2121 - RNA, 25 nt, Artificial Sequence
  Synthetic Oligonucleotide
aaucaucaaaggccaaagugaauga

SEQ ID NO: 2122 - RNA, 25 nt, Artificial Sequence
  Synthetic Oligonucleotide
augauuucuuagcugagauuuuuaa

SEQ ID NO: 2123 - RNA, 25 nt, Artificial Sequence
  Synthetic Oligonucleotide
gauuucuuagcugagauuuuuaaga

SEQ ID NO: 2124 - RNA, 25 nt, Artificial Sequence
  Synthetic Oligonucleotide
uuucuuagcugagauuuuuaagaag

SEQ ID NO: 2125 - RNA, 25 nt, Artificial Sequence
  Synthetic Oligonucleotide
ucuuagcugagauuuuuaagaagau

SEQ ID NO: 2126 - RNA, 25 nt, Artificial Sequence
  Synthetic Oligonucleotide
uuagcugagauuuuuaagaagauug

SEQ ID NO: 2127 - RNA, 25 nt, Artificial Sequence
  Synthetic Oligonucleotide
agcugagauuuuuaagaagauuggc

SEQ ID NO: 2128 - RNA, 25 nt, Artificial Sequence
  Synthetic Oligonucleotide
cugagauuuuuaagaagauuggcuc

SEQ ID NO: 2129 - RNA, 25 nt, Artificial Sequence
  Synthetic Oligonucleotide
gagauuuuuaagaagauuggcucua

SEQ ID NO: 2130 - RNA, 25 nt, Artificial Sequence
  Synthetic Oligonucleotide
gauuuuuaagaagauuggcucuaaa

SEQ ID NO: 2131 - RNA, 25 nt, Artificial Sequence
  Synthetic Oligonucleotide
uuuuuaagaagauuggcucuaaaga

SEQ ID NO: 2132 - RNA, 25 nt, Artificial Sequence
  Synthetic Oligonucleotide
uagcagaguuauaugaauauaagaa

SEQ ID NO: 2133 - RNA, 25 nt, Artificial Sequence
  Synthetic Oligonucleotide
gcagaguuauaugaauauaagaaga

SEQ ID NO: 2134 - RNA, 25 nt, Artificial Sequence
  Synthetic Oligonucleotide
agaguuauaugaauauaagaagaaa

SEQ ID NO: 2135 - RNA, 25 nt, Artificial Sequence
  Synthetic Oligonucleotide
aguuauaugaauauaagaagaaaua

SEQ ID NO: 2136 - RNA, 25 nt, Artificial Sequence
  Synthetic Oligonucleotide
uuauaugaauauaagaagaaauacu

SEQ ID NO: 2137 - RNA, 25 nt, Artificial Sequence
  Synthetic Oligonucleotide
auaugaauauaagaagaaauacuca

SEQ ID NO: 2138 - RNA, 25 nt, Artificial Sequence
  Synthetic Oligonucleotide
augaauauaagaagaaauacucaga

SEQ ID NO: 2139 - RNA, 25 nt, Artificial Sequence
  Synthetic Oligonucleotide
ugacauugaaccauuucugaaaaau

SEQ ID NO: 2140 - RNA, 25 nt, Artificial Sequence
  Synthetic Oligonucleotide
acauugaaccauuucugaaaaauuc

SEQ ID NO: 2141 - RNA, 25 nt, Artificial Sequence
  Synthetic Oligonucleotide
auugaaccauuucugaaaaauuccu

SEQ ID NO: 2142 - RNA, 25 nt, Artificial Sequence
  Synthetic Oligonucleotide
ugaaccauuucugaaaaauuccuca

SEQ ID NO: 2143 - RNA, 25 nt, Artificial Sequence
  Synthetic Oligonucleotide
aaccauuucugaaaaauuccucaca

SEQ ID NO: 2144 - RNA, 25 nt, Artificial Sequence
  Synthetic Oligonucleotide
ccauuucugaaaaauuccucacagu

SEQ ID NO: 2145 - RNA, 25 nt, Artificial Sequence
  Synthetic Oligonucleotide
agaggccuucgggugauugagaugg

SEQ ID NO: 2146 - RNA, 25 nt, Artificial Sequence
  Synthetic Oligonucleotide
aggccuucgggugauugagauggag

SEQ ID NO: 2147 - RNA, 25 nt, Artificial Sequence
  Synthetic Oligonucleotide
gccuucgggugauugagauggagag

SEQ ID NO: 2148 - RNA, 25 nt, Artificial Sequence
  Synthetic Oligonucleotide
cuucgggugauugagauggagaggg

SEQ ID NO: 2149 - RNA, 25 nt, Artificial Sequence
  Synthetic Oligonucleotide
ucgggugauugagauggagagggag

SEQ ID NO: 2150 - RNA, 25 nt, Artificial Sequence
  Synthetic Oligonucleotide
gggugauugagauggagagggaggg

SEQ ID NO: 2151 - RNA, 25 nt, Artificial Sequence
  Synthetic Oligonucleotide
ccaucugucuacuuggaaaggcuaa

SEQ ID NO: 2152 - RNA, 25 nt, Artificial Sequence
  Synthetic Oligonucleotide
aucugucuacuuggaaaggcuaaag

SEQ ID NO: 2153 - RNA, 25 nt, Artificial Sequence
  Synthetic Oligonucleotide
cugucuacuuggaaaggcuaaagau

SEQ ID NO: 2154 - RNA, 25 nt, Artificial Sequence
  Synthetic Oligonucleotide
gucuacuuggaaaggcuaaagaucc

SEQ ID NO: 2155 - RNA, 25 nt, Artificial Sequence
  Synthetic Oligonucleotide
ugaccucuuugcucuccaaaccagc

SEQ ID NO: 2156 - RNA, 25 nt, Artificial Sequence
  Synthetic Oligonucleotide
accucuuugcucuccaaaccagcag

SEQ ID NO: 2157 - RNA, 25 nt, Artificial Sequence
  Synthetic Oligonucleotide
cucuuugcucuccaaaccagcaguu

SEQ ID NO: 2158 - RNA, 25 nt, Artificial Sequence
  Synthetic Oligonucleotide
cuuugcucuccaaaccagcaguucc

SEQ ID NO: 2159 - RNA, 25 nt, Artificial Sequence
  Synthetic Oligonucleotide
ugaccuccuccuccuccacagcuaa

SEQ ID NO: 2160 - RNA, 25 nt, Artificial Sequence
  Synthetic Oligonucleotide
agacuggagagaauaaagagcaguc

SEQ ID NO: 2161 - RNA, 25 nt, Artificial Sequence
  Synthetic Oligonucleotide
acuggagagaauaaagagcagucgc

SEQ ID NO: 2162 - RNA, 25 nt, Artificial Sequence
  Synthetic Oligonucleotide
uggagagaauaaagagcagucgcaa

SEQ ID NO: 2163 - RNA, 25 nt, Artificial Sequence
  Synthetic Oligonucleotide
gagagaauaaagagcagucgcaaau

SEQ ID NO: 2164 - RNA, 25 nt, Artificial Sequence
  Synthetic Oligonucleotide
gagaauaaagagcagucgcaaauga

SEQ ID NO: 2165 - RNA, 25 nt, Artificial Sequence
  Synthetic Oligonucleotide
gaauaaagagcagucgcaaaugaag

SEQ ID NO: 2166 - RNA, 25 nt, Artificial Sequence
  Synthetic Oligonucleotide
auaaagagcagucgcaaaugaagcu

SEQ ID NO: 2167 - RNA, 25 nt, Artificial Sequence
  Synthetic Oligonucleotide
aaagagcagucgcaaaugaagcugc

SEQ ID NO: 2168 - RNA, 25 nt, Artificial Sequence
  Synthetic Oligonucleotide
agagcagucgcaaaugaagcugccc

SEQ ID NO: 2169 - RNA, 25 nt, Artificial Sequence
  Synthetic Oligonucleotide
aaacugguuguauguaucaugccgu

SEQ ID NO: 2170 - RNA, 25 nt, Artificial Sequence
  Synthetic Oligonucleotide
cucauuuguaaaauuguccuaaucu

SEQ ID NO: 2171 - RNA, 25 nt, Artificial Sequence
  Synthetic Oligonucleotide
cauuuguaaaauuguccuaaucuuu

SEQ ID NO: 2172 - RNA, 25 nt, Artificial Sequence
  Synthetic Oligonucleotide
uuuguaaaauuguccuaaucuuucc

SEQ ID NO: 2173 - RNA, 25 nt, Artificial Sequence
  Synthetic Oligonucleotide
acuguauucuguaugaaugcauggc

SEQ ID NO: 2174 - RNA, 25 nt, Artificial Sequence
  Synthetic Oligonucleotide
uguauucuguaugaaugcauggcau

SEQ ID NO: 2175 - RNA, 25 nt, Artificial Sequence
  Synthetic Oligonucleotide
uauucuguaugaaugcauggcauga

SEQ ID NO: 2176 - RNA, 25 nt, Artificial Sequence
  Synthetic Oligonucleotide
uucuguaugaaugcauggcaugaua

SEQ ID NO: 2177 - RNA, 25 nt, Artificial Sequence
  Synthetic Oligonucleotide
cuguaugaaugcauggcaugauaca

SEQ ID NO: 2178 - RNA, 25 nt, Artificial Sequence
  Synthetic Oligonucleotide
guaugaaugcauggcaugauacaac

SEQ ID NO: 2179 - RNA, 25 nt, Artificial Sequence
  Synthetic Oligonucleotide
uuuuauaaauaaaguuugcauuaac

SEQ ID NO: 2180 - RNA, 25 nt, Artificial Sequence
  Synthetic Oligonucleotide
uuauaaauaaaguuugcauuaacua

SEQ ID NO: 2181 - RNA, 25 nt, Artificial Sequence
  Synthetic Oligonucleotide
auaaauaaaguuugcauuaacuaua

SEQ ID NO: 2182 - RNA, 25 nt, Artificial Sequence
  Synthetic Oligonucleotide
aaauaaaguuugcauuaacuauacc

SEQ ID NO: 2183 - RNA, 25 nt, Artificial Sequence
  Synthetic Oligonucleotide
auaaaguuugcauuaacuauaccug

SEQ ID NO: 2184 - RNA, 25 nt, Artificial Sequence
  Synthetic Oligonucleotide
aaaguuugcauuaacuauaccugac

SEQ ID NO: 2185 - RNA, 25 nt, Artificial Sequence
  Synthetic Oligonucleotide
cagcugaggaaauacucuuaauucu

SEQ ID NO: 2186 - RNA, 25 nt, Artificial Sequence
  Synthetic Oligonucleotide
uugaaacugccaguugaucagaaau

SEQ ID NO: 2187 - RNA, 25 nt, Artificial Sequence
  Synthetic Oligonucleotide
gccaguugaucagaaaugugaacac

SEQ ID NO: 2188 - RNA, 25 nt, Artificial Sequence
  Synthetic Oligonucleotide
gaaagcaagguuaaguggguaugaa

SEQ ID NO: 2189 - RNA, 25 nt, Artificial Sequence
  Synthetic Oligonucleotide
cagagugguccaaauuuuuaggauu

SEQ ID NO: 2190 - RNA, 25 nt, Artificial Sequence
  Synthetic Oligonucleotide
gugguucaauugaaaggauuagaag

SEQ ID NO: 2191 - RNA, 25 nt, Artificial Sequence
  Synthetic Oligonucleotide
gauuagaagcugcacuuguuuaugu

SEQ ID NO: 2192 - RNA, 25 nt, Artificial Sequence
  Synthetic Oligonucleotide
cugcacuuguuuauguugaaaaugc

SEQ ID NO: 2193 - RNA, 25 nt, Artificial Sequence
  Synthetic Oligonucleotide
caggaaaaaccacaggagaaguugu

SEQ ID NO: 2194 - RNA, 25 nt, Artificial Sequence
  Synthetic Oligonucleotide
cagguguuguaaguaagguguucaa

SEQ ID NO: 2195 - RNA, 25 nt, Artificial Sequence
  Synthetic Oligonucleotide
guuguaaguaagguguucaaucaac

SEQ ID NO: 2196 - RNA, 25 nt, Artificial Sequence
  Synthetic Oligonucleotide
ucaaucaaccuaaagcuaaagccaa

SEQ ID NO: 2197 - RNA, 25 nt, Artificial Sequence
  Synthetic Oligonucleotide
ccugaaaggcuuggacaauaagaau

SEQ ID NO: 2198 - RNA, 25 nt, Artificial Sequence
  Synthetic Oligonucleotide
aagccaauuaucaaaguguugccaa

SEQ ID NO: 2199 - RNA, 25 nt, Artificial Sequence
  Synthetic Oligonucleotide
aaaguguugccaaaacucuuugagu

SEQ ID NO: 2200 - RNA, 25 nt, Artificial Sequence
  Synthetic Oligonucleotide
caaaacucuuugagucucgagagaa

SEQ ID NO: 2201 - RNA, 25 nt, Artificial Sequence
  Synthetic Oligonucleotide
cuguucgagaugaagccaaacuaau

SEQ ID NO: 2202 - RNA, 25 nt, Artificial Sequence
  Synthetic Oligonucleotide
cauuacaaaauauaaacucuguuca

SEQ ID NO: 2203 - RNA, 25 nt, Artificial Sequence
  Synthetic Oligonucleotide
aaaauauaaacucuguucaguugaa

SEQ ID NO: 2204 - RNA, 25 nt, Artificial Sequence
  Synthetic Oligonucleotide
auaaacucuguucaguugaaagaac

SEQ ID NO: 2205 - RNA, 25 nt, Artificial Sequence
  Synthetic Oligonucleotide
cuguucaguugaaagaacuagaaga

SEQ ID NO: 2206 - RNA, 25 nt, Artificial Sequence
  Synthetic Oligonucleotide
gaugaggugccacaaauagaugcuu

SEQ ID NO: 2207 - RNA, 25 nt, Artificial Sequence
  Synthetic Oligonucleotide
aaauagaugcuuaugagcuuuuaga

SEQ ID NO: 2208 - RNA, 25 nt, Artificial Sequence
  Synthetic Oligonucleotide
augagcuuuuagaagcuguagaaau

SEQ ID NO: 2209 - RNA, 25 nt, Artificial Sequence
  Synthetic Oligonucleotide
cccuggagucuguagaaguacuaau

SEQ ID NO: 2210 - RNA, 25 nt, Artificial Sequence
  Synthetic Oligonucleotide
gagucuguagaaguacuaauaaaaa

SEQ ID NO: 2211 - RNA, 25 nt, Artificial Sequence
  Synthetic Oligonucleotide
cagauuuaguaaaagcauuaaagaa

SEQ ID NO: 2212 - RNA, 25 nt, Artificial Sequence
  Synthetic Oligonucleotide
aaaagcauuaaagaagguuguugga

SEQ ID NO: 2213 - RNA, 25 nt, Artificial Sequence
  Synthetic Oligonucleotide
cauuaaagaagguuguuggaaagga

SEQ ID NO: 2214 - RNA, 25 nt, Artificial Sequence
  Synthetic Oligonucleotide
gaagguuguuggaaaggacaccaau

SEQ ID NO: 2215 - RNA, 25 nt, Artificial Sequence
  Synthetic Oligonucleotide
ggaagaaauuuggacaauaugcagg

SEQ ID NO: 2216 - RNA, 25 nt, Artificial Sequence
  Synthetic Oligonucleotide
gugaggauguuuuagcaguaaugga

SEQ ID NO: 2217 - RNA, 25 nt, Artificial Sequence
  Synthetic Oligonucleotide
guuuuagcaguaauggauaauaaaa

SEQ ID NO: 2218 - RNA, 25 nt, Artificial Sequence
  Synthetic Oligonucleotide
caagcagcagacaucucuuuuuauu

SEQ ID NO: 2219 - RNA, 25 nt, Artificial Sequence
  Synthetic Oligonucleotide
gacaucucuuuuuauugcaagaagu

SEQ ID NO: 2220 - RNA, 25 nt, Artificial Sequence
  Synthetic Oligonucleotide
ucagagaugccgcauuugaagcauu

SEQ ID NO: 2221 - RNA, 25 nt, Artificial Sequence
  Synthetic Oligonucleotide
cauuggguacugcuuugaagguggu

SEQ ID NO: 2222 - RNA, 25 nt, Artificial Sequence
  Synthetic Oligonucleotide
guggacaaacucaagcuugauaaga

SEQ ID NO: 2223 - RNA, 25 nt, Artificial Sequence
  Synthetic Oligonucleotide
aagaauguucagaaaagguagaacu

SEQ ID NO: 2224 - RNA, 25 nt, Artificial Sequence
  Synthetic Oligonucleotide
ucagaaaagguagaacugauacaug

SEQ ID NO: 2225 - RNA, 25 nt, Artificial Sequence
  Synthetic Oligonucleotide
gguagaacugauacaugguaagaaa

SEQ ID NO: 2226 - RNA, 25 nt, Artificial Sequence
  Synthetic Oligonucleotide
cagggaauacuggaaccaagaacaa

SEQ ID NO: 2227 - RNA, 25 nt, Artificial Sequence
  Synthetic Oligonucleotide
ccugagcucucgauagaaguaugug

SEQ ID NO: 2228 - RNA, 25 nt, Artificial Sequence
  Synthetic Oligonucleotide
cgauagaaguaugugaagaaaaagc

SEQ ID NO: 2229 - RNA, 25 nt, Artificial Sequence
  Synthetic Oligonucleotide
cuugacagcaguaacuggaaagaaa

SEQ ID NO: 2230 - RNA, 25 nt, Artificial Sequence
  Synthetic Oligonucleotide
gcuaauggaccgaacugaaaugcca

SEQ ID NO: 2231 - RNA, 25 nt, Artificial Sequence
  Synthetic Oligonucleotide
uuagugaggaugcuagccaagaaac

SEQ ID NO: 2232 - RNA, 25 nt, Artificial Sequence
  Synthetic Oligonucleotide
gccaagaaaccuggauggaaagaaa

SEQ ID NO: 2233 - RNA, 25 nt, Artificial Sequence
  Synthetic Oligonucleotide
gaaaccuggauggaaagaaacuaau

SEQ ID NO: 2234 - RNA, 25 nt, Artificial Sequence
  Synthetic Oligonucleotide
gugaugcaaaugaagcuucauauag

SEQ ID NO: 2235 - RNA, 25 nt, Artificial Sequence
  Synthetic Oligonucleotide
aaacgucagcucagguuguauuaga

SEQ ID NO: 2236 - RNA, 25 nt, Artificial Sequence
  Synthetic Oligonucleotide
caaaagaagcuaugacagcaauagc

SEQ ID NO: 2237 - RNA, 25 nt, Artificial Sequence
  Synthetic Oligonucleotide
cagcaauagccgaagccuguauguu

SEQ ID NO: 2238 - RNA, 25 nt, Artificial Sequence
  Synthetic Oligonucleotide
gaagccuguauguuaccauggacug

SEQ ID NO: 2239 - RNA, 25 nt, Artificial Sequence
  Synthetic Oligonucleotide
aaaaucagucagaaacucugaauug

SEQ ID NO: 2240 - RNA, 25 nt, Artificial Sequence
  Synthetic Oligonucleotide
agcuuucauuagcaaugugaagaca

SEQ ID NO: 2241 - RNA, 25 nt, Artificial Sequence
  Synthetic Oligonucleotide
gagaagaugcagggacaaaguccac

SEQ ID NO: 2242 - RNA, 25 nt, Artificial Sequence
  Synthetic Oligonucleotide
gcaaugaugucguugaucuuuugcc

SEQ ID NO: 2243 - RNA, 25 nt, Artificial Sequence
  Synthetic Oligonucleotide
gaaguggcagguauuauuaaugacg

SEQ ID NO: 2244 - RNA, 25 nt, Artificial Sequence
  Synthetic Oligonucleotide
gccuugaagggucgacucaaugauu

SEQ ID NO: 2245 - RNA, 25 nt, Artificial Sequence
  Synthetic Oligonucleotide
gaagggucgacucaaugauucaaau

SEQ ID NO: 2246 - RNA, 25 nt, Artificial Sequence
  Synthetic Oligonucleotide
gacucaaugauucaaauaaaaucuu

SEQ ID NO: 2247 - RNA, 25 nt, Artificial Sequence
  Synthetic Oligonucleotide
augauucaaauaaaaucuugguaca

SEQ ID NO: 2248 - RNA, 25 nt, Artificial Sequence
  Synthetic Oligonucleotide
agccaugggcccaaauauuaagcaa

SEQ ID NO: 2249 - RNA, 25 nt, Artificial Sequence
  Synthetic Oligonucleotide
aaauauuaagcaacauguaaaaaau

SEQ ID NO: 2250 - RNA, 25 nt, Artificial Sequence
  Synthetic Oligonucleotide
ccuuggagacagcaagaacaauguu

SEQ ID NO: 2251 - RNA, 25 nt, Artificial Sequence
  Synthetic Oligonucleotide
gagacagcaagaacaauguucgagc

SEQ ID NO: 2252 - RNA, 25 nt, Artificial Sequence
  Synthetic Oligonucleotide
caugaugcauuuaggauaugaaaaa

SEQ ID NO: 2253 - RNA, 25 nt, Artificial Sequence
  Synthetic Oligonucleotide
cuagagaaagccaaaguuaacaugc

SEQ ID NO: 2254 - RNA, 25 nt, Artificial Sequence
  Synthetic Oligonucleotide
gggaagaagaugccaagcaaaacca

SEQ ID NO: 2255 - RNA, 25 nt, Artificial Sequence
  Synthetic Oligonucleotide
gaaaagagcaaaggaugaaagauga

SEQ ID NO: 2256 - RNA, 25 nt, Artificial Sequence
  Synthetic Oligonucleotide
gagcaaaggaugaaagaugaaaaag

SEQ ID NO: 2257 - RNA, 25 nt, Artificial Sequence
  Synthetic Oligonucleotide
gggaugaauacauugagcaacuaaa

SEQ ID NO: 2258 - RNA, 25 nt, Artificial Sequence
  Synthetic Oligonucleotide
gaauacauugagcaacuaaagacuc

SEQ ID NO: 2259 - RNA, 25 nt, Artificial Sequence
  Synthetic Oligonucleotide
aguggcuuacccugagguuuuuuga

SEQ ID NO: 2260 - RNA, 25 nt, Artificial Sequence
  Synthetic Oligonucleotide
ccugagguuuuuugacaccaauaca

SEQ ID NO: 2261 - RNA, 25 nt, Artificial Sequence
  Synthetic Oligonucleotide
caauacaagcguccugaugaaagca

SEQ ID NO: 2262 - RNA, 25 nt, Artificial Sequence
  Synthetic Oligonucleotide
guccugaugaaagcacuagaauauu

SEQ ID NO: 2263 - RNA, 25 nt, Artificial Sequence
  Synthetic Oligonucleotide
augaaagcacuagaauauuuaaaau

SEQ ID NO: 2264 - RNA, 25 nt, Artificial Sequence
  Synthetic Oligonucleotide
gaaaucuuucugaaaaggauaugag

SEQ ID NO: 2265 - RNA, 25 nt, Artificial Sequence
  Synthetic Oligonucleotide
gaaaaggauaugagcaugcucgagg

SEQ ID NO: 2266 - RNA, 25 nt, Artificial Sequence
  Synthetic Oligonucleotide
gcuccaaugccaacauguuacgcaa

SEQ ID NO: 2267 - RNA, 25 nt, Artificial Sequence
  Synthetic Oligonucleotide
aaugccaacauguuacgcaagggac

SEQ ID NO: 2268 - RNA, 25 nt, Artificial Sequence
  Synthetic Oligonucleotide
gugaaaugccagaacuuguucagca

SEQ ID NO: 2269 - RNA, 25 nt, Artificial Sequence
  Synthetic Oligonucleotide
cagaacuuguucagcacaaacugga

SEQ ID NO: 2270 - RNA, 25 nt, Artificial Sequence
  Synthetic Oligonucleotide
acaaacuggaugacauuuuugagcc

SEQ ID NO: 2271 - RNA, 25 nt, Artificial Sequence
  Synthetic Oligonucleotide
gaugacauuuuugagccaguccuua

SEQ ID NO: 2272 - RNA, 25 nt, Artificial Sequence
  Synthetic Oligonucleotide
cauuuuugagccaguccuuauuccu

SEQ ID NO: 2273 - RNA, 25 nt, Artificial Sequence
  Synthetic Oligonucleotide
gagccaguccuuauuccugaaccca

SEQ ID NO: 2274 - RNA, 25 nt, Artificial Sequence
  Synthetic Oligonucleotide
cuggaguacuaaaagaccuaaugca

SEQ ID NO: 2275 - RNA, 25 nt, Artificial Sequence
  Synthetic Oligonucleotide
gugaagguucuggagaagucagacc

SEQ ID NO: 2276 - RNA, 25 nt, Artificial Sequence
  Synthetic Oligonucleotide
ccugagugcccuacuuguuuugcuc

SEQ ID NO: 2277 - RNA, 25 nt, Artificial Sequence
  Synthetic Oligonucleotide
cagccaguucucccaaauucucaga

SEQ ID NO: 2278 - RNA, 25 nt, Artificial Sequence
  Synthetic Oligonucleotide
gcuuguuaugaagugucucuggaga

SEQ ID NO: 2279 - RNA, 25 nt, Artificial Sequence
  Synthetic Oligonucleotide
cgacuguugccugauaccaucaaua

SEQ ID NO: 2280 - RNA, 25 nt, Artificial Sequence
  Synthetic Oligonucleotide
guugccugauaccaucaauagcauu

SEQ ID NO: 2281 - RNA, 25 nt, Artificial Sequence
  Synthetic Oligonucleotide
cugauaccaucaauagcauuaaccu

SEQ ID NO: 2282 - RNA, 25 nt, Artificial Sequence
  Synthetic Oligonucleotide
aucaauagcauuaaccuagacagaa

SEQ ID NO: 2283 - RNA, 25 nt, Artificial Sequence
  Synthetic Oligonucleotide
uagcauuaaccuagacagaauucuu

SEQ ID NO: 2284 - RNA, 25 nt, Artificial Sequence
  Synthetic Oligonucleotide
gaauucuucuggauauccacauuuu

SEQ ID NO: 2285 - RNA, 25 nt, Artificial Sequence
  Synthetic Oligonucleotide
cuggauauccacauuuucaugaagg

SEQ ID NO: 2286 - RNA, 25 nt, Artificial Sequence
  Synthetic Oligonucleotide
aaagagaaacugaagcaaugcaaaa

SEQ ID NO: 2287 - RNA, 25 nt, Artificial Sequence
  Synthetic Oligonucleotide
gaaacugaagcaaugcaaaagugaa

SEQ ID NO: 2288 - RNA, 25 nt, Artificial Sequence
  Synthetic Oligonucleotide
cggaugaugaagcacaguauggacc

SEQ ID NO: 2289 - RNA, 25 nt, Artificial Sequence
  Synthetic Oligonucleotide
cagaaaagggagcaucucgaauaga

SEQ ID NO: 2290 - RNA, 25 nt, Artificial Sequence
  Synthetic Oligonucleotide
agggagcaucucgaauagaugaaaa

SEQ ID NO: 2291 - RNA, 25 nt, Artificial Sequence
  Synthetic Oligonucleotide
gcaucucgaauagaugaaaaaucau

SEQ ID NO: 2292 - RNA, 25 nt, Artificial Sequence
  Synthetic Oligonucleotide
gagggacuagcagaguuauaugaau

SEQ ID NO: 2293 - RNA, 25 nt, Artificial Sequence
  Synthetic Oligonucleotide
acucagaugcugacauugaaccauu

SEQ ID NO: 2294 - RNA, 25 nt, Artificial Sequence
  Synthetic Oligonucleotide
cauucagaccuggauucuaaccaga

SEQ ID NO: 2295 - RNA, 25 nt, Artificial Sequence
  Synthetic Oligonucleotide
gaccuggauucuaaccagacucacu

SEQ ID NO: 2296 - RNA, 25 nt, Artificial Sequence
  Synthetic Oligonucleotide
ggauucuaaccagacucacucuuca

SEQ ID NO: 2297 - RNA, 25 nt, Artificial Sequence
  Synthetic Oligonucleotide
gcuaacauagacgacuugaaaaaaa

SEQ ID NO: 2298 - RNA, 25 nt, Artificial Sequence
  Synthetic Oligonucleotide
cauagacgacuugaaaaaaagacug

SEQ ID NO: 2299 - RNA, 25 nt, Artificial Sequence
  Synthetic Oligonucleotide
cuagaaguccucauaguuuaaaaug

SEQ ID NO: 2300 - RNA, 25 nt, Artificial Sequence
  Synthetic Oligonucleotide
gaugaguuuaguguacagacuugua

SEQ ID NO: 2301 - RNA, 25 nt, Artificial Sequence
  Synthetic Oligonucleotide
cagauccuuuucuuuucuuuuuaau

SEQ ID NO: 2302 - RNA, 25 nt, Artificial Sequence
  Synthetic Oligonucleotide
ugcucauuuguaaaauuguccuaau

SEQ ID NO: 2303 - RNA, 25 nt, Artificial Sequence
  Synthetic Oligonucleotide
gaagggucacuguauucuguaugaa

SEQ ID NO: 2304 - RNA, 25 nt, Artificial Sequence
  Synthetic Oligonucleotide
gucacuguauucuguaugaaugcau

SEQ ID NO: 2305 - RNA, 21 nt, Artificial Sequence
  Synthetic Oligonucleotide
uggaagcacaaugggagauga

SEQ ID NO: 2306 - RNA, 21 nt, Artificial Sequence
  Synthetic Oligonucleotide
gaagcacaaugggagaugaca

SEQ ID NO: 2307 - RNA, 21 nt, Artificial Sequence
  Synthetic Oligonucleotide
agcacaaugggagaugacagu

SEQ ID NO: 2308 - RNA, 21 nt, Artificial Sequence
  Synthetic Oligonucleotide
cacaaugggagaugacaguga

SEQ ID NO: 2309 - RNA, 21 nt, Artificial Sequence
  Synthetic Oligonucleotide
caaugggagaugacagugagu

SEQ ID NO: 2310 - RNA, 21 nt, Artificial Sequence
  Synthetic Oligonucleotide
augggagaugacagugagugg

SEQ ID NO: 2311 - RNA, 21 nt, Artificial Sequence
  Synthetic Oligonucleotide
gggagaugacagugagugguu

SEQ ID NO: 2312 - RNA, 21 nt, Artificial Sequence
  Synthetic Oligonucleotide
gagaugacagugagugguuga

SEQ ID NO: 2313 - RNA, 21 nt, Artificial Sequence
  Synthetic Oligonucleotide
gaugacagugagugguugaaa

SEQ ID NO: 2314 - RNA, 21 nt, Artificial Sequence
  Synthetic Oligonucleotide
cugaagaucuuccagaaaaua

SEQ ID NO: 2315 - RNA, 21 nt, Artificial Sequence
  Synthetic Oligonucleotide
gaagaucuuccagaaaauaaa

SEQ ID NO: 2316 - RNA, 21 nt, Artificial Sequence
  Synthetic Oligonucleotide
agaucuuccagaaaauaaagg

SEQ ID NO: 2317 - RNA, 21 nt, Artificial Sequence
  Synthetic Oligonucleotide
aucuuccagaaaauaaaggau

SEQ ID NO: 2318 - RNA, 21 nt, Artificial Sequence
  Synthetic Oligonucleotide
cuuccagaaaauaaaggauga

SEQ ID NO: 2319 - RNA, 21 nt, Artificial Sequence
  Synthetic Oligonucleotide
uccagaaaauaaaggaugaaa

SEQ ID NO: 2320 - RNA, 21 nt, Artificial Sequence
  Synthetic Oligonucleotide
cagaaaauaaaggaugaaaag

SEQ ID NO: 2321 - RNA, 21 nt, Artificial Sequence
  Synthetic Oligonucleotide
gaaaauaaaggaugaaaagag

SEQ ID NO: 2322 - RNA, 21 nt, Artificial Sequence
  Synthetic Oligonucleotide
gaucaaaaaauuugucacuga

SEQ ID NO: 2323 - RNA, 21 nt, Artificial Sequence
  Synthetic Oligonucleotide
ucaaaaaauuugucacugauu

SEQ ID NO: 2324 - RNA, 21 nt, Artificial Sequence
  Synthetic Oligonucleotide
aaaaaauuugucacugauucc

SEQ ID NO: 2325 - RNA, 21 nt, Artificial Sequence
  Synthetic Oligonucleotide
aaaauuugucacugauuccaa

SEQ ID NO: 2326 - RNA, 21 nt, Artificial Sequence
  Synthetic Oligonucleotide
aauuugucacugauuccaaug

SEQ ID NO: 2327 - RNA, 21 nt, Artificial Sequence
  Synthetic Oligonucleotide
uuugucacugauuccaaugca

SEQ ID NO: 2328 - RNA, 21 nt, Artificial Sequence
  Synthetic Oligonucleotide
ugucacugauuccaaugcagu

SEQ ID NO: 2329 - RNA, 21 nt, Artificial Sequence
  Synthetic Oligonucleotide
ucacugauuccaaugcagugg

SEQ ID NO: 2330 - RNA, 21 nt, Artificial Sequence
  Synthetic Oligonucleotide
acugauuccaaugcagugguu

SEQ ID NO: 2331 - RNA, 21 nt, Artificial Sequence
  Synthetic Oligonucleotide
ugauuccaaugcagugguuca

SEQ ID NO: 2332 - RNA, 21 nt, Artificial Sequence
  Synthetic Oligonucleotide
auuccaaugcagugguucaau

SEQ ID NO: 2333 - RNA, 21 nt, Artificial Sequence
  Synthetic Oligonucleotide
uccaaugcagugguucaauug

SEQ ID NO: 2334 - RNA, 21 nt, Artificial Sequence
  Synthetic Oligonucleotide
caaugcagugguucaauugaa

SEQ ID NO: 2335 - RNA, 21 nt, Artificial Sequence
  Synthetic Oligonucleotide
augcagugguucaauugaaag

SEQ ID NO: 2336 - RNA, 21 nt, Artificial Sequence
  Synthetic Oligonucleotide
gcagugguucaauugaaagga

SEQ ID NO: 2337 - RNA, 21 nt, Artificial Sequence
  Synthetic Oligonucleotide
ccaagaucauaguggccugua

SEQ ID NO: 2338 - RNA, 21 nt, Artificial Sequence
  Synthetic Oligonucleotide
aagaucauaguggccuguaua

SEQ ID NO: 2339 - RNA, 21 nt, Artificial Sequence
  Synthetic Oligonucleotide
gaucauaguggccuguauaga

SEQ ID NO: 2340 - RNA, 21 nt, Artificial Sequence
  Synthetic Oligonucleotide
gacacugaggaaagccuuaag

SEQ ID NO: 2341 - RNA, 21 nt, Artificial Sequence
  Synthetic Oligonucleotide
cacugaggaaagccuuaagug

SEQ ID NO: 2342 - RNA, 21 nt, Artificial Sequence
  Synthetic Oligonucleotide
cugaggaaagccuuaagugaa

SEQ ID NO: 2343 - RNA, 21 nt, Artificial Sequence
  Synthetic Oligonucleotide
gaggaaagccuuaagugaauu

SEQ ID NO: 2344 - RNA, 21 nt, Artificial Sequence
  Synthetic Oligonucleotide
ggaaagccuuaagugaauuug

SEQ ID NO: 2345 - RNA, 21 nt, Artificial Sequence
  Synthetic Oligonucleotide
aaagccuuaagugaauuuggu

SEQ ID NO: 2346 - RNA, 21 nt, Artificial Sequence
  Synthetic Oligonucleotide
agccuuaagugaauuugguuc

SEQ ID NO: 2347 - RNA, 21 nt, Artificial Sequence
  Synthetic Oligonucleotide
ccuuaagugaauuugguucca

SEQ ID NO: 2348 - RNA, 21 nt, Artificial Sequence
  Synthetic Oligonucleotide
uuaagugaauuugguuccaaa

SEQ ID NO: 2349 - RNA, 21 nt, Artificial Sequence
  Synthetic Oligonucleotide
aagugaauuugguuccaaaau

SEQ ID NO: 2350 - RNA, 21 nt, Artificial Sequence
  Synthetic Oligonucleotide
gugaauuugguuccaaaauca

SEQ ID NO: 2351 - RNA, 21 nt, Artificial Sequence
  Synthetic Oligonucleotide
gaauuugguuccaaaaucauc

SEQ ID NO: 2352 - RNA, 21 nt, Artificial Sequence
  Synthetic Oligonucleotide
uucguucccaacaagaacuag

SEQ ID NO: 2353 - RNA, 21 nt, Artificial Sequence
  Synthetic Oligonucleotide
cguucccaacaagaacuagaa

SEQ ID NO: 2354 - RNA, 21 nt, Artificial Sequence
  Synthetic Oligonucleotide
uucccaacaagaacuagaagc

SEQ ID NO: 2355 - RNA, 21 nt, Artificial Sequence
  Synthetic Oligonucleotide
cccaacaagaacuagaagcua

SEQ ID NO: 2356 - RNA, 21 nt, Artificial Sequence
  Synthetic Oligonucleotide
caacaagaacuagaagcuaaa

SEQ ID NO: 2357 - RNA, 21 nt, Artificial Sequence
  Synthetic Oligonucleotide
acaacagucugcugguggaga

SEQ ID NO: 2358 - RNA, 21 nt, Artificial Sequence
  Synthetic Oligonucleotide
aacagucugcugguggagaug

SEQ ID NO: 2359 - RNA, 21 nt, Artificial Sequence
  Synthetic Oligonucleotide
agguggugaugauggugauga

SEQ ID NO: 2360 - RNA, 21 nt, Artificial Sequence
  Synthetic Oligonucleotide
guggugaugauggugaugagg

SEQ ID NO: 2361 - RNA, 21 nt, Artificial Sequence
  Synthetic Oligonucleotide
aaauccuuuccaaacuuccca

SEQ ID NO: 2362 - RNA, 21 nt, Artificial Sequence
  Synthetic Oligonucleotide
auccuuuccaaacuucccaaa

SEQ ID NO: 2363 - RNA, 21 nt, Artificial Sequence
  Synthetic Oligonucleotide
ccuuuccaaacuucccaaaga

SEQ ID NO: 2364 - RNA, 21 nt, Artificial Sequence
  Synthetic Oligonucleotide
uuuccaaacuucccaaagacu

SEQ ID NO: 2365 - RNA, 21 nt, Artificial Sequence
  Synthetic Oligonucleotide
uccaaacuucccaaagacuuu

SEQ ID NO: 2366 - RNA, 21 nt, Artificial Sequence
  Synthetic Oligonucleotide
caaacuucccaaagacuuuua

SEQ ID NO: 2367 - RNA, 21 nt, Artificial Sequence
  Synthetic Oligonucleotide
aacuucccaaagacuuuuaug

SEQ ID NO: 2368 - RNA, 21 nt, Artificial Sequence
  Synthetic Oligonucleotide
cuucccaaagacuuuuaugac

SEQ ID NO: 2369 - RNA, 21 nt, Artificial Sequence
  Synthetic Oligonucleotide
ucccaaagacuuuuaugacaa

SEQ ID NO: 2370 - RNA, 21 nt, Artificial Sequence
  Synthetic Oligonucleotide
ccaaagacuuuuaugacaaaa

SEQ ID NO: 2371 - RNA, 21 nt, Artificial Sequence
  Synthetic Oligonucleotide
aaagacuuuuaugacaaaauu

SEQ ID NO: 2372 - RNA, 21 nt, Artificial Sequence
  Synthetic Oligonucleotide
agacuuuuaugacaaaauuga

SEQ ID NO: 2373 - RNA, 21 nt, Artificial Sequence
  Synthetic Oligonucleotide
acuuuuaugacaaaauugagg

SEQ ID NO: 2374 - RNA, 21 nt, Artificial Sequence
  Synthetic Oligonucleotide
uuuuaugacaaaauugaggca

SEQ ID NO: 2375 - RNA, 21 nt, Artificial Sequence
  Synthetic Oligonucleotide
uuaugacaaaauugaggcaaa

SEQ ID NO: 2376 - RNA, 21 nt, Artificial Sequence
  Synthetic Oligonucleotide
aaaauggcaagagagaaaaga

SEQ ID NO: 2377 - RNA, 21 nt, Artificial Sequence
  Synthetic Oligonucleotide
gaagguuguuggaaaggacac

SEQ ID NO: 2378 - RNA, 21 nt, Artificial Sequence
  Synthetic Oligonucleotide
agguuguuggaaaggacacca

SEQ ID NO: 2379 - RNA, 21 nt, Artificial Sequence
  Synthetic Oligonucleotide
guuguuggaaaggacaccaau

SEQ ID NO: 2380 - RNA, 21 nt, Artificial Sequence
  Synthetic Oligonucleotide
uguuggaaaggacaccaaugu

SEQ ID NO: 2381 - RNA, 21 nt, Artificial Sequence
  Synthetic Oligonucleotide
uuggaaaggacaccaauguca

SEQ ID NO: 2382 - RNA, 21 nt, Artificial Sequence
  Synthetic Oligonucleotide
ggaaaggacaccaaugucaug

SEQ ID NO: 2383 - RNA, 21 nt, Artificial Sequence
  Synthetic Oligonucleotide
aaaggacaccaaugucauguu

SEQ ID NO: 2384 - RNA, 21 nt, Artificial Sequence
  Synthetic Oligonucleotide
aggacaccaaugucauguugg

SEQ ID NO: 2385 - RNA, 21 nt, Artificial Sequence
  Synthetic Oligonucleotide
uggcuuuggcagcaaaauguc

SEQ ID NO: 2386 - RNA, 21 nt, Artificial Sequence
  Synthetic Oligonucleotide
gcuuuggcagcaaaaugucuu

SEQ ID NO: 2387 - RNA, 21 nt, Artificial Sequence
  Synthetic Oligonucleotide
uuuggcagcaaaaugucuuac

SEQ ID NO: 2388 - RNA, 21 nt, Artificial Sequence
  Synthetic Oligonucleotide
uggcagcaaaaugucuuacug

SEQ ID NO: 2389 - RNA, 21 nt, Artificial Sequence
  Synthetic Oligonucleotide
gcagcaaaaugucuuacuggc

SEQ ID NO: 2390 - RNA, 21 nt, Artificial Sequence
  Synthetic Oligonucleotide
gaagaaauuuggacaauaugc

SEQ ID NO: 2391 - RNA, 21 nt, Artificial Sequence
  Synthetic Oligonucleotide
agaaauuuggacaauaugcag

SEQ ID NO: 2392 - RNA, 21 nt, Artificial Sequence
  Synthetic Oligonucleotide
aaauuuggacaauaugcagga

SEQ ID NO: 2393 - RNA, 21 nt, Artificial Sequence
  Synthetic Oligonucleotide
auuuggacaauaugcaggaca

SEQ ID NO: 2394 - RNA, 21 nt, Artificial Sequence
  Synthetic Oligonucleotide
uuggacaauaugcaggacaug

SEQ ID NO: 2395 - RNA, 21 nt, Artificial Sequence
  Synthetic Oligonucleotide
ggacaauaugcaggacauguu

SEQ ID NO: 2396 - RNA, 21 nt, Artificial Sequence
  Synthetic Oligonucleotide
acaauaugcaggacauguugu

SEQ ID NO: 2397 - RNA, 21 nt, Artificial Sequence
  Synthetic Oligonucleotide
aauaugcaggacauguugugc

SEQ ID NO: 2398 - RNA, 21 nt, Artificial Sequence
  Synthetic Oligonucleotide
uaugcaggacauguugugcca

SEQ ID NO: 2399 - RNA, 21 nt, Artificial Sequence
  Synthetic Oligonucleotide
ugcaggacauguugugccaac

SEQ ID NO: 2400 - RNA, 21 nt, Artificial Sequence
  Synthetic Oligonucleotide
accucaagugguacaagcccu

SEQ ID NO: 2401 - RNA, 21 nt, Artificial Sequence
  Synthetic Oligonucleotide
cucaagugguacaagcccugc

SEQ ID NO: 2402 - RNA, 21 nt, Artificial Sequence
  Synthetic Oligonucleotide
caagugguacaagcccugcag

SEQ ID NO: 2403 - RNA, 21 nt, Artificial Sequence
  Synthetic Oligonucleotide
agugguacaagcccugcagga

SEQ ID NO: 2404 - RNA, 21 nt, Artificial Sequence
  Synthetic Oligonucleotide
ugguacaagcccugcaggagg

SEQ ID NO: 2405 - RNA, 21 nt, Artificial Sequence
  Synthetic Oligonucleotide
guacaagcccugcaggaggca

SEQ ID NO: 2406 - RNA, 21 nt, Artificial Sequence
  Synthetic Oligonucleotide
acaagcccugcaggaggcaau

SEQ ID NO: 2407 - RNA, 21 nt, Artificial Sequence
  Synthetic Oligonucleotide
aagcccugcaggaggcaauug

SEQ ID NO: 2408 - RNA, 21 nt, Artificial Sequence
  Synthetic Oligonucleotide
gcccugcaggaggcaauugau

SEQ ID NO: 2409 - RNA, 21 nt, Artificial Sequence
  Synthetic Oligonucleotide
ccugcaggaggcaauugaugc

SEQ ID NO: 2410 - RNA, 21 nt, Artificial Sequence
  Synthetic Oligonucleotide
ugcaggaggcaauugaugcaa

SEQ ID NO: 2411 - RNA, 21 nt, Artificial Sequence
  Synthetic Oligonucleotide
caggaggcaauugaugcaauc

SEQ ID NO: 2412 - RNA, 21 nt, Artificial Sequence
  Synthetic Oligonucleotide
ggaggcaauugaugcaaucuu

SEQ ID NO: 2413 - RNA, 21 nt, Artificial Sequence
  Synthetic Oligonucleotide
aggcaauugaugcaaucuucc

SEQ ID NO: 2414 - RNA, 21 nt, Artificial Sequence
  Synthetic Oligonucleotide
uuacuaccacacuacagaaca

SEQ ID NO: 2415 - RNA, 21 nt, Artificial Sequence
  Synthetic Oligonucleotide
acuaccacacuacagaacauc

SEQ ID NO: 2416 - RNA, 21 nt, Artificial Sequence
  Synthetic Oligonucleotide
uaccacacuacagaacaucag

SEQ ID NO: 2417 - RNA, 21 nt, Artificial Sequence
  Synthetic Oligonucleotide
ccacacuacagaacaucagug

SEQ ID NO: 2418 - RNA, 21 nt, Artificial Sequence
  Synthetic Oligonucleotide
acacuacagaacaucagugag

SEQ ID NO: 2419 - RNA, 21 nt, Artificial Sequence
  Synthetic Oligonucleotide
acuacagaacaucagugagga

SEQ ID NO: 2420 - RNA, 21 nt, Artificial Sequence
  Synthetic Oligonucleotide
uacagaacaucagugaggaug

SEQ ID NO: 2421 - RNA, 21 nt, Artificial Sequence
  Synthetic Oligonucleotide
uuuuagcaguaauggauaaua

SEQ ID NO: 2422 - RNA, 21 nt, Artificial Sequence
  Synthetic Oligonucleotide
uuagcaguaauggauaauaaa

SEQ ID NO: 2423 - RNA, 21 nt, Artificial Sequence
  Synthetic Oligonucleotide
agcaguaauggauaauaaaaa

SEQ ID NO: 2424 - RNA, 21 nt, Artificial Sequence
  Synthetic Oligonucleotide
caguaauggauaauaaaaauc

SEQ ID NO: 2425 - RNA, 21 nt, Artificial Sequence
  Synthetic Oligonucleotide
caaccaucaagcagcagacau

SEQ ID NO: 2426 - RNA, 21 nt, Artificial Sequence
  Synthetic Oligonucleotide
cacuacuuaagcacaucaaug

SEQ ID NO: 2427 - RNA, 21 nt, Artificial Sequence
  Synthetic Oligonucleotide
cuacuuaagcacaucaaugau

SEQ ID NO: 2428 - RNA, 21 nt, Artificial Sequence
  Synthetic Oligonucleotide
acuuaagcacaucaaugauuc

SEQ ID NO: 2429 - RNA, 21 nt, Artificial Sequence
  Synthetic Oligonucleotide
uuaagcacaucaaugauucug

SEQ ID NO: 2430 - RNA, 21 nt, Artificial Sequence
  Synthetic Oligonucleotide
aagcacaucaaugauucugcu

SEQ ID NO: 2431 - RNA, 21 nt, Artificial Sequence
  Synthetic Oligonucleotide
gcacaucaaugauucugcucc

SEQ ID NO: 2432 - RNA, 21 nt, Artificial Sequence
  Synthetic Oligonucleotide
acaucaaugauucugcuccug

SEQ ID NO: 2433 - RNA, 21 nt, Artificial Sequence
  Synthetic Oligonucleotide
aucaaugauucugcuccugaa

SEQ ID NO: 2434 - RNA, 21 nt, Artificial Sequence
  Synthetic Oligonucleotide
caaugauucugcuccugaagu

SEQ ID NO: 2435 - RNA, 21 nt, Artificial Sequence
  Synthetic Oligonucleotide
augauucugcuccugaaguca

SEQ ID NO: 2436 - RNA, 21 nt, Artificial Sequence
  Synthetic Oligonucleotide
gauucugcuccugaagucaga

SEQ ID NO: 2437 - RNA, 21 nt, Artificial Sequence
  Synthetic Oligonucleotide
uucugcuccugaagucagaga

SEQ ID NO: 2438 - RNA, 21 nt, Artificial Sequence
  Synthetic Oligonucleotide
cugcuccugaagucagagaug

SEQ ID NO: 2439 - RNA, 21 nt, Artificial Sequence
  Synthetic Oligonucleotide
aagaucaaagaauguucagaa

SEQ ID NO: 2440 - RNA, 21 nt, Artificial Sequence
  Synthetic Oligonucleotide
gaucaaagaauguucagaaaa

SEQ ID NO: 2441 - RNA, 21 nt, Artificial Sequence
  Synthetic Oligonucleotide
gaaaccuggauggaaagaaac

SEQ ID NO: 2442 - RNA, 21 nt, Artificial Sequence
  Synthetic Oligonucleotide
aaccuggauggaaagaaacua

SEQ ID NO: 2443 - RNA, 21 nt, Artificial Sequence
  Synthetic Oligonucleotide
ccuggauggaaagaaacuaau

SEQ ID NO: 2444 - RNA, 21 nt, Artificial Sequence
  Synthetic Oligonucleotide
uggauggaaagaaacuaauuu

SEQ ID NO: 2445 - RNA, 21 nt, Artificial Sequence
  Synthetic Oligonucleotide
gauggaaagaaacuaauuuuc

SEQ ID NO: 2446 - RNA, 21 nt, Artificial Sequence
  Synthetic Oligonucleotide
uggaaagaaacuaauuuucag

SEQ ID NO: 2447 - RNA, 21 nt, Artificial Sequence
  Synthetic Oligonucleotide
gaaagaaacuaauuuucaggu

SEQ ID NO: 2448 - RNA, 21 nt, Artificial Sequence
  Synthetic Oligonucleotide
aagaaacuaauuuucagguga

SEQ ID NO: 2449 - RNA, 21 nt, Artificial Sequence
  Synthetic Oligonucleotide
gaaacuaauuuucaggugaug

SEQ ID NO: 2450 - RNA, 21 nt, Artificial Sequence
  Synthetic Oligonucleotide
aacuaauuuucaggugaugca

SEQ ID NO: 2451 - RNA, 21 nt, Artificial Sequence
  Synthetic Oligonucleotide
aguugcuuugauugcccagaa

SEQ ID NO: 2452 - RNA, 21 nt, Artificial Sequence
  Synthetic Oligonucleotide
uugcuuugauugcccagaagg

SEQ ID NO: 2453 - RNA, 21 nt, Artificial Sequence
  Synthetic Oligonucleotide
gcuuugauugcccagaaggga

SEQ ID NO: 2454 - RNA, 21 nt, Artificial Sequence
  Synthetic Oligonucleotide
uuugauugcccagaagggaaa

SEQ ID NO: 2455 - RNA, 21 nt, Artificial Sequence
  Synthetic Oligonucleotide
ugauugcccagaagggaaauu

SEQ ID NO: 2456 - RNA, 21 nt, Artificial Sequence
  Synthetic Oligonucleotide
auugcccagaagggaaauuuu

SEQ ID NO: 2457 - RNA, 21 nt, Artificial Sequence
  Synthetic Oligonucleotide
ugcccagaagggaaauuuuuc

SEQ ID NO: 2458 - RNA, 21 nt, Artificial Sequence
  Synthetic Oligonucleotide
uggacaagauuggagauguga

SEQ ID NO: 2459 - RNA, 21 nt, Artificial Sequence
  Synthetic Oligonucleotide
gacaagauuggagaugugaaa

SEQ ID NO: 2460 - RNA, 21 nt, Artificial Sequence
  Synthetic Oligonucleotide
caagauuggagaugugaaaug

SEQ ID NO: 2461 - RNA, 21 nt, Artificial Sequence
  Synthetic Oligonucleotide
agauuggagaugugaaaugug

SEQ ID NO: 2462 - RNA, 21 nt, Artificial Sequence
  Synthetic Oligonucleotide
auuggagaugugaaauguggg

SEQ ID NO: 2463 - RNA, 21 nt, Artificial Sequence
  Synthetic Oligonucleotide
uggagaugugaaaugugggaa

SEQ ID NO: 2464 - RNA, 21 nt, Artificial Sequence
  Synthetic Oligonucleotide
gagaugugaaaugugggaaca

SEQ ID NO: 2465 - RNA, 21 nt, Artificial Sequence
  Synthetic Oligonucleotide
gaugugaaaugugggaacaau

SEQ ID NO: 2466 - RNA, 21 nt, Artificial Sequence
  Synthetic Oligonucleotide
ugugaaaugugggaacaaugc

SEQ ID NO: 2467 - RNA, 21 nt, Artificial Sequence
  Synthetic Oligonucleotide
ugaaaugugggaacaaugcaa

SEQ ID NO: 2468 - RNA, 21 nt, Artificial Sequence
  Synthetic Oligonucleotide
aaaugugggaacaaugcaaaa

SEQ ID NO: 2469 - RNA, 21 nt, Artificial Sequence
  Synthetic Oligonucleotide
augugggaacaaugcaaaaga

SEQ ID NO: 2470 - RNA, 21 nt, Artificial Sequence
  Synthetic Oligonucleotide
gugggaacaaugcaaaagaag

SEQ ID NO: 2471 - RNA, 21 nt, Artificial Sequence
  Synthetic Oligonucleotide
ggguugaaugucaaagcuuuc

SEQ ID NO: 2472 - RNA, 21 nt, Artificial Sequence
  Synthetic Oligonucleotide
guugaaugucaaagcuuucau

SEQ ID NO: 2473 - RNA, 21 nt, Artificial Sequence
  Synthetic Oligonucleotide
ugaaugucaaagcuuucauua

SEQ ID NO: 2474 - RNA, 21 nt, Artificial Sequence
  Synthetic Oligonucleotide
aaugucaaagcuuucauuagc

SEQ ID NO: 2475 - RNA, 21 nt, Artificial Sequence
  Synthetic Oligonucleotide
ugucaaagcuuucauuagcaa

SEQ ID NO: 2476 - RNA, 21 nt, Artificial Sequence
  Synthetic Oligonucleotide
aacccugcuuggcgugaugua

SEQ ID NO: 2477 - RNA, 21 nt, Artificial Sequence
  Synthetic Oligonucleotide
cccugcuuggcgugauguauc

SEQ ID NO: 2478 - RNA, 21 nt, Artificial Sequence
  Synthetic Oligonucleotide
guucuuugaggaugagaagcc

SEQ ID NO: 2479 - RNA, 21 nt, Artificial Sequence
  Synthetic Oligonucleotide
ucuuugaggaugagaagccug

SEQ ID NO: 2480 - RNA, 21 nt, Artificial Sequence
  Synthetic Oligonucleotide
uuugaggaugagaagccugcc

SEQ ID NO: 2481 - RNA, 21 nt, Artificial Sequence
  Synthetic Oligonucleotide
ugaggaugagaagccugcccu

SEQ ID NO: 2482 - RNA, 21 nt, Artificial Sequence
  Synthetic Oligonucleotide
aggaugagaagccugcccucc

SEQ ID NO: 2483 - RNA, 21 nt, Artificial Sequence
  Synthetic Oligonucleotide
gaugagaagccugcccuccua

SEQ ID NO: 2484 - RNA, 21 nt, Artificial Sequence
  Synthetic Oligonucleotide
ugagaagccugcccuccuauc

SEQ ID NO: 2485 - RNA, 21 nt, Artificial Sequence
  Synthetic Oligonucleotide
agaagccugcccuccuauccc

SEQ ID NO: 2486 - RNA, 21 nt, Artificial Sequence
  Synthetic Oligonucleotide
aagccugcccuccuaucccag

SEQ ID NO: 2487 - RNA, 21 nt, Artificial Sequence
  Synthetic Oligonucleotide
gccugcccuccuaucccagau

SEQ ID NO: 2488 - RNA, 21 nt, Artificial Sequence
  Synthetic Oligonucleotide
cugcccuccuaucccagauag

SEQ ID NO: 2489 - RNA, 21 nt, Artificial Sequence
  Synthetic Oligonucleotide
gcccuccuaucccagauagau

SEQ ID NO: 2490 - RNA, 21 nt, Artificial Sequence
  Synthetic Oligonucleotide
ccuccuaucccagauagaugc

SEQ ID NO: 2491 - RNA, 21 nt, Artificial Sequence
  Synthetic Oligonucleotide
uccuaucccagauagaugcag

SEQ ID NO: 2492 - RNA, 21 nt, Artificial Sequence
  Synthetic Oligonucleotide
cuaucccagauagaugcagaa

SEQ ID NO: 2493 - RNA, 21 nt, Artificial Sequence
  Synthetic Oligonucleotide
aucccagauagaugcagaauu

SEQ ID NO: 2494 - RNA, 21 nt, Artificial Sequence
  Synthetic Oligonucleotide
agaagaugcagggacaaaguc

SEQ ID NO: 2495 - RNA, 21 nt, Artificial Sequence
  Synthetic Oligonucleotide
gguacagaugaaggagaagau

SEQ ID NO: 2496 - RNA, 21 nt, Artificial Sequence
  Synthetic Oligonucleotide
uacagaugaaggagaagaugg

SEQ ID NO: 2497 - RNA, 21 nt, Artificial Sequence
  Synthetic Oligonucleotide
cagaugaaggagaagauggag

SEQ ID NO: 2498 - RNA, 21 nt, Artificial Sequence
  Synthetic Oligonucleotide
ucguugaucuuuugccgagga

SEQ ID NO: 2499 - RNA, 21 nt, Artificial Sequence
  Synthetic Oligonucleotide
uaggaaagaaggccuagauga

SEQ ID NO: 2500 - RNA, 21 nt, Artificial Sequence
  Synthetic Oligonucleotide
ggaaagaaggccuagaugaag

SEQ ID NO: 2501 - RNA, 21 nt, Artificial Sequence
  Synthetic Oligonucleotide
aaagaaggccuagaugaagug

SEQ ID NO: 2502 - RNA, 21 nt, Artificial Sequence
  Synthetic Oligonucleotide
agaaggccuagaugaaguggc

SEQ ID NO: 2503 - RNA, 21 nt, Artificial Sequence
  Synthetic Oligonucleotide
aaggccuagaugaaguggcag

SEQ ID NO: 2504 - RNA, 21 nt, Artificial Sequence
  Synthetic Oligonucleotide
ggccuagaugaaguggcaggu

SEQ ID NO: 2505 - RNA, 21 nt, Artificial Sequence
  Synthetic Oligonucleotide
ccuagaugaaguggcagguau

SEQ ID NO: 2506 - RNA, 21 nt, Artificial Sequence
  Synthetic Oligonucleotide
uagaugaaguggcagguauua

SEQ ID NO: 2507 - RNA, 21 nt, Artificial Sequence
  Synthetic Oligonucleotide
cgaauauaggugaacuuccaa

SEQ ID NO: 2508 - RNA, 21 nt, Artificial Sequence
  Synthetic Oligonucleotide
aauauaggugaacuuccaacu

SEQ ID NO: 2509 - RNA, 21 nt, Artificial Sequence
  Synthetic Oligonucleotide
uauaggugaacuuccaacugc

SEQ ID NO: 2510 - RNA, 21 nt, Artificial Sequence
  Synthetic Oligonucleotide
uaggugaacuuccaacugccu

SEQ ID NO: 2511 - RNA, 21 nt, Artificial Sequence
  Synthetic Oligonucleotide
ggugaacuuccaacugccuug

SEQ ID NO: 2512 - RNA, 21 nt, Artificial Sequence
  Synthetic Oligonucleotide
ugaacuuccaacugccuugaa

SEQ ID NO: 2513 - RNA, 21 nt, Artificial Sequence
  Synthetic Oligonucleotide
aacuuccaacugccuugaagg

SEQ ID NO: 2514 - RNA, 21 nt, Artificial Sequence
  Synthetic Oligonucleotide
cuuccaacugccuugaagggu

SEQ ID NO: 2515 - RNA, 21 nt, Artificial Sequence
  Synthetic Oligonucleotide
uccaacugccuugaagggucg

SEQ ID NO: 2516 - RNA, 21 nt, Artificial Sequence
  Synthetic Oligonucleotide
caacugccuugaagggucgac

SEQ ID NO: 2517 - RNA, 21 nt, Artificial Sequence
  Synthetic Oligonucleotide
aacaacuggcaguagccaugg

SEQ ID NO: 2518 - RNA, 21 nt, Artificial Sequence
  Synthetic Oligonucleotide
acagcaagaacaauguucgag

SEQ ID NO: 2519 - RNA, 21 nt, Artificial Sequence
  Synthetic Oligonucleotide
agcaagaacaauguucgagcu

SEQ ID NO: 2520 - RNA, 21 nt, Artificial Sequence
  Synthetic Oligonucleotide
caagaacaauguucgagcugc

SEQ ID NO: 2521 - RNA, 21 nt, Artificial Sequence
  Synthetic Oligonucleotide
agaacaauguucgagcugcug

SEQ ID NO: 2522 - RNA, 21 nt, Artificial Sequence
  Synthetic Oligonucleotide
aacaauguucgagcugcugcc

SEQ ID NO: 2523 - RNA, 21 nt, Artificial Sequence
  Synthetic Oligonucleotide
caauguucgagcugcugcccu

SEQ ID NO: 2524 - RNA, 21 nt, Artificial Sequence
  Synthetic Oligonucleotide
auguucgagcugcugcccuag

SEQ ID NO: 2525 - RNA, 21 nt, Artificial Sequence
  Synthetic Oligonucleotide
cgacugugaaugcuugggcag

SEQ ID NO: 2526 - RNA, 21 nt, Artificial Sequence
  Synthetic Oligonucleotide
acugugaaugcuugggcagaa

SEQ ID NO: 2527 - RNA, 21 nt, Artificial Sequence
  Synthetic Oligonucleotide
ugugaaugcuugggcagaaca

SEQ ID NO: 2528 - RNA, 21 nt, Artificial Sequence
  Synthetic Oligonucleotide
aggagaagaucuuucugaaga

SEQ ID NO: 2529 - RNA, 21 nt, Artificial Sequence
  Synthetic Oligonucleotide
gccuagaagaucgaaauggag

SEQ ID NO: 2530 - RNA, 21 nt, Artificial Sequence
  Synthetic Oligonucleotide
cuagaagaucgaaauggagau

SEQ ID NO: 2531 - RNA, 21 nt, Artificial Sequence
  Synthetic Oligonucleotide
agaagaucgaaauggagaugu

SEQ ID NO: 2532 - RNA, 21 nt, Artificial Sequence
  Synthetic Oligonucleotide
caugaugcauuuaggauauga

SEQ ID NO: 2533 - RNA, 21 nt, Artificial Sequence
  Synthetic Oligonucleotide
ugaugcauuuaggauaugaaa

SEQ ID NO: 2534 - RNA, 21 nt, Artificial Sequence
  Synthetic Oligonucleotide
augcauuuaggauaugaaaaa

SEQ ID NO: 2535 - RNA, 21 nt, Artificial Sequence
  Synthetic Oligonucleotide
gcauuuaggauaugaaaaaau

SEQ ID NO: 2536 - RNA, 21 nt, Artificial Sequence
  Synthetic Oligonucleotide
auuuaggauaugaaaaaaugg

SEQ ID NO: 2537 - RNA, 21 nt, Artificial Sequence
  Synthetic Oligonucleotide
ccaaggcuacugggaaacuaa

SEQ ID NO: 2538 - RNA, 21 nt, Artificial Sequence
  Synthetic Oligonucleotide
aaggcuacugggaaacuaaag

SEQ ID NO: 2539 - RNA, 21 nt, Artificial Sequence
  Synthetic Oligonucleotide
ggcuacugggaaacuaaagcc

SEQ ID NO: 2540 - RNA, 21 nt, Artificial Sequence
  Synthetic Oligonucleotide
cuacugggaaacuaaagccaa

SEQ ID NO: 2541 - RNA, 21 nt, Artificial Sequence
  Synthetic Oligonucleotide
acugggaaacuaaagccaacu

SEQ ID NO: 2542 - RNA, 21 nt, Artificial Sequence
  Synthetic Oligonucleotide
ugggaaacuaaagccaacuuc

SEQ ID NO: 2543 - RNA, 21 nt, Artificial Sequence
  Synthetic Oligonucleotide
ggaaacuaaagccaacuucua

SEQ ID NO: 2544 - RNA, 21 nt, Artificial Sequence
  Synthetic Oligonucleotide
aaacuaaagccaacuucuaaa

SEQ ID NO: 2545 - RNA, 21 nt, Artificial Sequence
  Synthetic Oligonucleotide
acuaaagccaacuucuaaaga

SEQ ID NO: 2546 - RNA, 21 nt, Artificial Sequence
  Synthetic Oligonucleotide
uaaagccaacuucuaaagauc

SEQ ID NO: 2547 - RNA, 21 nt, Artificial Sequence
  Synthetic Oligonucleotide
ggccuauuuuuauuguuguuc

SEQ ID NO: 2548 - RNA, 21 nt, Artificial Sequence
  Synthetic Oligonucleotide
ccuauuuuuauuguuguucca

SEQ ID NO: 2549 - RNA, 21 nt, Artificial Sequence
  Synthetic Oligonucleotide
uauuuuuauuguuguuccaaa

SEQ ID NO: 2550 - RNA, 21 nt, Artificial Sequence
  Synthetic Oligonucleotide
uuuuuauuguuguuccaaaug

SEQ ID NO: 2551 - RNA, 21 nt, Artificial Sequence
  Synthetic Oligonucleotide
uuuauuguuguuccaaaugga

SEQ ID NO: 2552 - RNA, 21 nt, Artificial Sequence
  Synthetic Oligonucleotide
uauuguuguuccaaauggaaa

SEQ ID NO: 2553 - RNA, 21 nt, Artificial Sequence
  Synthetic Oligonucleotide
gaaggugcuaaaguggaauuu

SEQ ID NO: 2554 - RNA, 21 nt, Artificial Sequence
  Synthetic Oligonucleotide
aggugcuaaaguggaauuuua

SEQ ID NO: 2555 - RNA, 21 nt, Artificial Sequence
  Synthetic Oligonucleotide
auaucaucuuacugagaauga

SEQ ID NO: 2556 - RNA, 21 nt, Artificial Sequence
  Synthetic Oligonucleotide
aucaucuuacugagaaugaag

SEQ ID NO: 2557 - RNA, 21 nt, Artificial Sequence
  Synthetic Oligonucleotide
caucuuacugagaaugaagca

SEQ ID NO: 2558 - RNA, 21 nt, Artificial Sequence
  Synthetic Oligonucleotide
ucuuacugagaaugaagcauc

SEQ ID NO: 2559 - RNA, 21 nt, Artificial Sequence
  Synthetic Oligonucleotide
gucaagguuggagaaccaaag

SEQ ID NO: 2560 - RNA, 21 nt, Artificial Sequence
  Synthetic Oligonucleotide
caagguuggagaaccaaagga

SEQ ID NO: 2561 - RNA, 21 nt, Artificial Sequence
  Synthetic Oligonucleotide
agguuggagaaccaaaggaug

SEQ ID NO: 2562 - RNA, 21 nt, Artificial Sequence
  Synthetic Oligonucleotide
guuggagaaccaaaggauguc

SEQ ID NO: 2563 - RNA, 21 nt, Artificial Sequence
  Synthetic Oligonucleotide
uggagaaccaaaggaugucau

SEQ ID NO: 2564 - RNA, 21 nt, Artificial Sequence
  Synthetic Oligonucleotide
gagaaccaaaggaugucauuc

SEQ ID NO: 2565 - RNA, 21 nt, Artificial Sequence
  Synthetic Oligonucleotide
gaaccaaaggaugucauucgu

SEQ ID NO: 2566 - RNA, 21 nt, Artificial Sequence
  Synthetic Oligonucleotide
accaaaggaugucauucguaa

SEQ ID NO: 2567 - RNA, 21 nt, Artificial Sequence
  Synthetic Oligonucleotide
caaaggaugucauucguaaag

SEQ ID NO: 2568 - RNA, 21 nt, Artificial Sequence
  Synthetic Oligonucleotide
aaggaugucauucguaaagau

SEQ ID NO: 2569 - RNA, 21 nt, Artificial Sequence
  Synthetic Oligonucleotide
ggaugucauucguaaagaugu

SEQ ID NO: 2570 - RNA, 21 nt, Artificial Sequence
  Synthetic Oligonucleotide
cauccugaaccggaugugccu

SEQ ID NO: 2571 - RNA, 21 nt, Artificial Sequence
  Synthetic Oligonucleotide
uccugaaccggaugugccuug

SEQ ID NO: 2572 - RNA, 21 nt, Artificial Sequence
  Synthetic Oligonucleotide
cugaaccggaugugccuuguc

SEQ ID NO: 2573 - RNA, 21 nt, Artificial Sequence
  Synthetic Oligonucleotide
gaaccggaugugccuugucua

SEQ ID NO: 2574 - RNA, 21 nt, Artificial Sequence
  Synthetic Oligonucleotide
accggaugugccuugucuacc

SEQ ID NO: 2575 - RNA, 21 nt, Artificial Sequence
  Synthetic Oligonucleotide
cggaugugccuugucuaccca

SEQ ID NO: 2576 - RNA, 21 nt, Artificial Sequence
  Synthetic Oligonucleotide
gaugugccuugucuacccagc

SEQ ID NO: 2577 - RNA, 21 nt, Artificial Sequence
  Synthetic Oligonucleotide
auccaaaaacucuaagcagag

SEQ ID NO: 2578 - RNA, 21 nt, Artificial Sequence
  Synthetic Oligonucleotide
ccaaaaacucuaagcagagag

SEQ ID NO: 2579 - RNA, 21 nt, Artificial Sequence
  Synthetic Oligonucleotide
aaaaacucuaagcagagagca

SEQ ID NO: 2580 - RNA, 21 nt, Artificial Sequence
  Synthetic Oligonucleotide
aaacucuaagcagagagcaga

SEQ ID NO: 2581 - RNA, 21 nt, Artificial Sequence
  Synthetic Oligonucleotide
acucuaagcagagagcagagu

SEQ ID NO: 2582 - RNA, 21 nt, Artificial Sequence
  Synthetic Oligonucleotide
ucuaagcagagagcagagugc

SEQ ID NO: 2583 - RNA, 21 nt, Artificial Sequence
  Synthetic Oligonucleotide
uaagcagagagcagagugccu

SEQ ID NO: 2584 - RNA, 21 nt, Artificial Sequence
  Synthetic Oligonucleotide
agcagagagcagagugccugg

SEQ ID NO: 2585 - RNA, 21 nt, Artificial Sequence
  Synthetic Oligonucleotide
cagagagcagagugccuggaa

SEQ ID NO: 2586 - RNA, 21 nt, Artificial Sequence
  Synthetic Oligonucleotide
gagagcagagugccuggaaga

SEQ ID NO: 2587 - RNA, 21 nt, Artificial Sequence
  Synthetic Oligonucleotide
gagcagagugccuggaagagc

SEQ ID NO: 2588 - RNA, 21 nt, Artificial Sequence
  Synthetic Oligonucleotide
cccaggaaaagccuuaaagga

SEQ ID NO: 2589 - RNA, 21 nt, Artificial Sequence
  Synthetic Oligonucleotide
ggaucagguguucaaacugau

SEQ ID NO: 2590 - RNA, 21 nt, Artificial Sequence
  Synthetic Oligonucleotide
aucagguguucaaacugauug

SEQ ID NO: 2591 - RNA, 21 nt, Artificial Sequence
  Synthetic Oligonucleotide
cagguguucaaacugauugga

SEQ ID NO: 2592 - RNA, 21 nt, Artificial Sequence
  Synthetic Oligonucleotide
gguguucaaacugauuggaaa

SEQ ID NO: 2593 - RNA, 21 nt, Artificial Sequence
  Synthetic Oligonucleotide
uguucaaacugauuggaaauc

SEQ ID NO: 2594 - RNA, 21 nt, Artificial Sequence
  Synthetic Oligonucleotide
uucaaacugauuggaaaucuu

SEQ ID NO: 2595 - RNA, 21 nt, Artificial Sequence
  Synthetic Oligonucleotide
caaacugauuggaaaucuuuc

SEQ ID NO: 2596 - RNA, 21 nt, Artificial Sequence
  Synthetic Oligonucleotide
aacugauuggaaaucuuucug

SEQ ID NO: 2597 - RNA, 21 nt, Artificial Sequence
  Synthetic Oligonucleotide
uuaagcggucagcaaagagac

SEQ ID NO: 2598 - RNA, 21 nt, Artificial Sequence
  Synthetic Oligonucleotide
aagcggucagcaaagagaccc

SEQ ID NO: 2599 - RNA, 21 nt, Artificial Sequence
  Synthetic Oligonucleotide
gcggucagcaaagagacccuc

SEQ ID NO: 2600 - RNA, 21 nt, Artificial Sequence
  Synthetic Oligonucleotide
ggucagcaaagagacccucug

SEQ ID NO: 2601 - RNA, 21 nt, Artificial Sequence
  Synthetic Oligonucleotide
ucagcaaagagacccucugcu

SEQ ID NO: 2602 - RNA, 21 nt, Artificial Sequence
  Synthetic Oligonucleotide
agcaaagagacccucugcugc

SEQ ID NO: 2603 - RNA, 21 nt, Artificial Sequence
  Synthetic Oligonucleotide
caaagagacccucugcugcac

SEQ ID NO: 2604 - RNA, 21 nt, Artificial Sequence
  Synthetic Oligonucleotide
guuacgcaagggaccagcuga

SEQ ID NO: 2605 - RNA, 21 nt, Artificial Sequence
  Synthetic Oligonucleotide
uacgcaagggaccagcugagg

SEQ ID NO: 2606 - RNA, 21 nt, Artificial Sequence
  Synthetic Oligonucleotide
uccgccgagaauuccagcugg

SEQ ID NO: 2607 - RNA, 21 nt, Artificial Sequence
  Synthetic Oligonucleotide
cgccgagaauuccagcuggau

SEQ ID NO: 2608 - RNA, 21 nt, Artificial Sequence
  Synthetic Oligonucleotide
caagauccgggcuguuucucc

SEQ ID NO: 2609 - RNA, 21 nt, Artificial Sequence
  Synthetic Oligonucleotide
agauccgggcuguuucuccac

SEQ ID NO: 2610 - RNA, 21 nt, Artificial Sequence
  Synthetic Oligonucleotide
ucgaugacaugcacaguaaua

SEQ ID NO: 2611 - RNA, 21 nt, Artificial Sequence
  Synthetic Oligonucleotide
gaugacaugcacaguaauaca

SEQ ID NO: 2612 - RNA, 21 nt, Artificial Sequence
  Synthetic Oligonucleotide
ugacaugcacaguaauacagc

SEQ ID NO: 2613 - RNA, 21 nt, Artificial Sequence
  Synthetic Oligonucleotide
acaugcacaguaauacagcau

SEQ ID NO: 2614 - RNA, 21 nt, Artificial Sequence
  Synthetic Oligonucleotide
augcacaguaauacagcaucc

SEQ ID NO: 2615 - RNA, 21 nt, Artificial Sequence
  Synthetic Oligonucleotide
gcacaguaauacagcauccac

SEQ ID NO: 2616 - RNA, 21 nt, Artificial Sequence
  Synthetic Oligonucleotide
acaguaauacagcauccacaa

SEQ ID NO: 2617 - RNA, 21 nt, Artificial Sequence
  Synthetic Oligonucleotide
aguaauacagcauccacaauc

SEQ ID NO: 2618 - RNA, 21 nt, Artificial Sequence
  Synthetic Oligonucleotide
uaauacagcauccacaaucaa

SEQ ID NO: 2619 - RNA, 21 nt, Artificial Sequence
  Synthetic Oligonucleotide
auacagcauccacaaucaauu

SEQ ID NO: 2620 - RNA, 21 nt, Artificial Sequence
  Synthetic Oligonucleotide
acagcauccacaaucaauuuc

SEQ ID NO: 2621 - RNA, 21 nt, Artificial Sequence
  Synthetic Oligonucleotide
agcauccacaaucaauuucau

SEQ ID NO: 2622 - RNA, 21 nt, Artificial Sequence
  Synthetic Oligonucleotide
cauccacaaucaauuucauua

SEQ ID NO: 2623 - RNA, 21 nt, Artificial Sequence
  Synthetic Oligonucleotide
uccacaaucaauuucauuauc

SEQ ID NO: 2624 - RNA, 21 nt, Artificial Sequence
  Synthetic Oligonucleotide
cacaaucaauuucauuaucuc

SEQ ID NO: 2625 - RNA, 21 nt, Artificial Sequence
  Synthetic Oligonucleotide
caaucaauuucauuaucuccc

SEQ ID NO: 2626 - RNA, 21 nt, Artificial Sequence
  Synthetic Oligonucleotide
aucaauuucauuaucucccaa

SEQ ID NO: 2627 - RNA, 21 nt, Artificial Sequence
  Synthetic Oligonucleotide
caauuucauuaucucccaagu

SEQ ID NO: 2628 - RNA, 21 nt, Artificial Sequence
  Synthetic Oligonucleotide
auuucauuaucucccaaguag

SEQ ID NO: 2629 - RNA, 21 nt, Artificial Sequence
  Synthetic Oligonucleotide
uucauuaucucccaaguagcc

SEQ ID NO: 2630 - RNA, 21 nt, Artificial Sequence
  Synthetic Oligonucleotide
cauuaucucccaaguagccag

SEQ ID NO: 2631 - RNA, 21 nt, Artificial Sequence
  Synthetic Oligonucleotide
uuaucucccaaguagccagug

SEQ ID NO: 2632 - RNA, 21 nt, Artificial Sequence
  Synthetic Oligonucleotide
aucucccaaguagccaguggu

SEQ ID NO: 2633 - RNA, 21 nt, Artificial Sequence
  Synthetic Oligonucleotide
cucccaaguagccagugguga

SEQ ID NO: 2634 - RNA, 21 nt, Artificial Sequence
  Synthetic Oligonucleotide
cccaaguagccaguggugaca

SEQ ID NO: 2635 - RNA, 21 nt, Artificial Sequence
  Synthetic Oligonucleotide
uugcccgggaggccuccacug

SEQ ID NO: 2636 - RNA, 21 nt, Artificial Sequence
  Synthetic Oligonucleotide
gcccgggaggccuccacugga

SEQ ID NO: 2637 - RNA, 21 nt, Artificial Sequence
  Synthetic Oligonucleotide
ccgggaggccuccacuggagu

SEQ ID NO: 2638 - RNA, 21 nt, Artificial Sequence
  Synthetic Oligonucleotide
gggaggccuccacuggaguac

SEQ ID NO: 2639 - RNA, 21 nt, Artificial Sequence
  Synthetic Oligonucleotide
ucaucaccuuaaugcuggauu

SEQ ID NO: 2640 - RNA, 21 nt, Artificial Sequence
  Synthetic Oligonucleotide
aucaccuuaaugcuggauucu

SEQ ID NO: 2641 - RNA, 21 nt, Artificial Sequence
  Synthetic Oligonucleotide
caccuuaaugcuggauucucg

SEQ ID NO: 2642 - RNA, 21 nt, Artificial Sequence
  Synthetic Oligonucleotide
ccuuaaugcuggauucucgga

SEQ ID NO: 2643 - RNA, 21 nt, Artificial Sequence
  Synthetic Oligonucleotide
uuaaugcuggauucucggauu

SEQ ID NO: 2644 - RNA, 21 nt, Artificial Sequence
  Synthetic Oligonucleotide
aaugcuggauucucggauuga

SEQ ID NO: 2645 - RNA, 21 nt, Artificial Sequence
  Synthetic Oligonucleotide
ugcuggauucucggauugaag

SEQ ID NO: 2646 - RNA, 21 nt, Artificial Sequence
  Synthetic Oligonucleotide
cuggauucucggauugaagau

SEQ ID NO: 2647 - RNA, 21 nt, Artificial Sequence
  Synthetic Oligonucleotide
ggauucucggauugaagaucu

SEQ ID NO: 2648 - RNA, 21 nt, Artificial Sequence
  Synthetic Oligonucleotide
cucugugaaccucuugguggu

SEQ ID NO: 2649 - RNA, 21 nt, Artificial Sequence
  Synthetic Oligonucleotide
cugugaaccucuuggugguga

SEQ ID NO: 2650 - RNA, 21 nt, Artificial Sequence
  Synthetic Oligonucleotide
gugaaccucuugguggugaag

SEQ ID NO: 2651 - RNA, 21 nt, Artificial Sequence
  Synthetic Oligonucleotide
gaaccucuugguggugaaggu

SEQ ID NO: 2652 - RNA, 21 nt, Artificial Sequence
  Synthetic Oligonucleotide
aagacagccugcuagcaacag

SEQ ID NO: 2653 - RNA, 21 nt, Artificial Sequence
  Synthetic Oligonucleotide
ccaguucucccaaauucucag

SEQ ID NO: 2654 - RNA, 21 nt, Artificial Sequence
  Synthetic Oligonucleotide
aguucucccaaauucucagag

SEQ ID NO: 2655 - RNA, 21 nt, Artificial Sequence
  Synthetic Oligonucleotide
uucucccaaauucucagagcu

SEQ ID NO: 2656 - RNA, 21 nt, Artificial Sequence
  Synthetic Oligonucleotide
cucccaaauucucagagcuug

SEQ ID NO: 2657 - RNA, 21 nt, Artificial Sequence
  Synthetic Oligonucleotide
cccaaauucucagagcuuguu

SEQ ID NO: 2658 - RNA, 21 nt, Artificial Sequence
  Synthetic Oligonucleotide
caaauucucagagcuuguuau

SEQ ID NO: 2659 - RNA, 21 nt, Artificial Sequence
  Synthetic Oligonucleotide
aauucucagagcuuguuauga

SEQ ID NO: 2660 - RNA, 21 nt, Artificial Sequence
  Synthetic Oligonucleotide
uucucagagcuuguuaugaag

SEQ ID NO: 2661 - RNA, 21 nt, Artificial Sequence
  Synthetic Oligonucleotide
cucagagcuuguuaugaagug

SEQ ID NO: 2662 - RNA, 21 nt, Artificial Sequence
  Synthetic Oligonucleotide
cagagcuuguuaugaaguguc

SEQ ID NO: 2663 - RNA, 21 nt, Artificial Sequence
  Synthetic Oligonucleotide
auagcauuaaccuagacagaa

SEQ ID NO: 2664 - RNA, 21 nt, Artificial Sequence
  Synthetic Oligonucleotide
agcauuaaccuagacagaauu

SEQ ID NO: 2665 - RNA, 21 nt, Artificial Sequence
  Synthetic Oligonucleotide
cauuaaccuagacagaauucu

SEQ ID NO: 2666 - RNA, 21 nt, Artificial Sequence
  Synthetic Oligonucleotide
uuaaccuagacagaauucuuc

SEQ ID NO: 2667 - RNA, 21 nt, Artificial Sequence
  Synthetic Oligonucleotide
aaccuagacagaauucuucug

SEQ ID NO: 2668 - RNA, 21 nt, Artificial Sequence
  Synthetic Oligonucleotide
ccuagacagaauucuucugga

SEQ ID NO: 2669 - RNA, 21 nt, Artificial Sequence
  Synthetic Oligonucleotide
uauccacauuuucaugaaggu

SEQ ID NO: 2670 - RNA, 21 nt, Artificial Sequence
  Synthetic Oligonucleotide
cugaagcaaugcaaaagugaa

SEQ ID NO: 2671 - RNA, 21 nt, Artificial Sequence
  Synthetic Oligonucleotide
gaagcaaugcaaaagugaauu

SEQ ID NO: 2672 - RNA, 21 nt, Artificial Sequence
  Synthetic Oligonucleotide
agcaaugcaaaagugaauuuc

SEQ ID NO: 2673 - RNA, 21 nt, Artificial Sequence
  Synthetic Oligonucleotide
acaguauggaccagacuggga

SEQ ID NO: 2674 - RNA, 21 nt, Artificial Sequence
  Synthetic Oligonucleotide
aguauggaccagacugggagc

SEQ ID NO: 2675 - RNA, 21 nt, Artificial Sequence
  Synthetic Oligonucleotide
uauggaccagacugggagcaa

SEQ ID NO: 2676 - RNA, 21 nt, Artificial Sequence
  Synthetic Oligonucleotide
uggaccagacugggagcaagu

SEQ ID NO: 2677 - RNA, 21 nt, Artificial Sequence
  Synthetic Oligonucleotide
gaccagacugggagcaagucu

SEQ ID NO: 2678 - RNA, 21 nt, Artificial Sequence
  Synthetic Oligonucleotide
ccagacugggagcaagucuga

SEQ ID NO: 2679 - RNA, 21 nt, Artificial Sequence
  Synthetic Oligonucleotide
agacugggagcaagucugaua

SEQ ID NO: 2680 - RNA, 21 nt, Artificial Sequence
  Synthetic Oligonucleotide
acugggagcaagucugauaag

SEQ ID NO: 2681 - RNA, 21 nt, Artificial Sequence
  Synthetic Oligonucleotide
ugggagcaagucugauaagga

SEQ ID NO: 2682 - RNA, 21 nt, Artificial Sequence
  Synthetic Oligonucleotide
ggagcaagucugauaaggaaa

SEQ ID NO: 2683 - RNA, 21 nt, Artificial Sequence
  Synthetic Oligonucleotide
agcaagucugauaaggaaaca

SEQ ID NO: 2684 - RNA, 21 nt, Artificial Sequence
  Synthetic Oligonucleotide
caagucugauaaggaaacaga

SEQ ID NO: 2685 - RNA, 21 nt, Artificial Sequence
  Synthetic Oligonucleotide
agucugauaaggaaacagaaa

SEQ ID NO: 2686 - RNA, 21 nt, Artificial Sequence
  Synthetic Oligonucleotide
ucugauaaggaaacagaaaag

SEQ ID NO: 2687 - RNA, 21 nt, Artificial Sequence
  Synthetic Oligonucleotide
ugauaaggaaacagaaaaggg

SEQ ID NO: 2688 - RNA, 21 nt, Artificial Sequence
  Synthetic Oligonucleotide
auaaggaaacagaaaagggag

SEQ ID NO: 2689 - RNA, 21 nt, Artificial Sequence
  Synthetic Oligonucleotide
caucucgaauagaugaaaaau

SEQ ID NO: 2690 - RNA, 21 nt, Artificial Sequence
  Synthetic Oligonucleotide
ucucgaauagaugaaaaauca

SEQ ID NO: 2691 - RNA, 21 nt, Artificial Sequence
  Synthetic Oligonucleotide
ucgaauagaugaaaaaucauc

SEQ ID NO: 2692 - RNA, 21 nt, Artificial Sequence
  Synthetic Oligonucleotide
gaauagaugaaaaaucaucaa

SEQ ID NO: 2693 - RNA, 21 nt, Artificial Sequence
  Synthetic Oligonucleotide
auagaugaaaaaucaucaaag

SEQ ID NO: 2694 - RNA, 21 nt, Artificial Sequence
  Synthetic Oligonucleotide
agaugaaaaaucaucaaaggc

SEQ ID NO: 2695 - RNA, 21 nt, Artificial Sequence
  Synthetic Oligonucleotide
augaaaaaucaucaaaggcca

SEQ ID NO: 2696 - RNA, 21 nt, Artificial Sequence
  Synthetic Oligonucleotide
gaaaaaucaucaaaggccaaa

SEQ ID NO: 2697 - RNA, 21 nt, Artificial Sequence
  Synthetic Oligonucleotide
aaaaucaucaaaggccaaagu

SEQ ID NO: 2698 - RNA, 21 nt, Artificial Sequence
  Synthetic Oligonucleotide
gaaugauuucuuagcugagau

SEQ ID NO: 2699 - RNA, 21 nt, Artificial Sequence
  Synthetic Oligonucleotide
augauuucuuagcugagauuu

SEQ ID NO: 2700 - RNA, 21 nt, Artificial Sequence
  Synthetic Oligonucleotide
gauuucuuagcugagauuuuu

SEQ ID NO: 2701 - RNA, 21 nt, Artificial Sequence
  Synthetic Oligonucleotide
uuucuuagcugagauuuuuaa

SEQ ID NO: 2702 - RNA, 21 nt, Artificial Sequence
  Synthetic Oligonucleotide
ucuuagcugagauuuuuaaga

SEQ ID NO: 2703 - RNA, 21 nt, Artificial Sequence
  Synthetic Oligonucleotide
uuagcugagauuuuuaagaag

SEQ ID NO: 2704 - RNA, 21 nt, Artificial Sequence
  Synthetic Oligonucleotide
agcugagauuuuuaagaagau

SEQ ID NO: 2705 - RNA, 21 nt, Artificial Sequence
  Synthetic Oligonucleotide
cugagauuuuuaagaagauug

SEQ ID NO: 2706 - RNA, 21 nt, Artificial Sequence
  Synthetic Oligonucleotide
gagauuuuuaagaagauuggc

SEQ ID NO: 2707 - RNA, 21 nt, Artificial Sequence
  Synthetic Oligonucleotide
gauuuuuaagaagauuggcuc

SEQ ID NO: 2708 - RNA, 21 nt, Artificial Sequence
  Synthetic Oligonucleotide
acuagcagaguuauaugaaua

SEQ ID NO: 2709 - RNA, 21 nt, Artificial Sequence
  Synthetic Oligonucleotide
uagcagaguuauaugaauaua

SEQ ID NO: 2710 - RNA, 21 nt, Artificial Sequence
  Synthetic Oligonucleotide
gcagaguuauaugaauauaag

SEQ ID NO: 2711 - RNA, 21 nt, Artificial Sequence
  Synthetic Oligonucleotide
agaguuauaugaauauaagaa

SEQ ID NO: 2712 - RNA, 21 nt, Artificial Sequence
  Synthetic Oligonucleotide
aguuauaugaauauaagaaga

SEQ ID NO: 2713 - RNA, 21 nt, Artificial Sequence
  Synthetic Oligonucleotide
uuauaugaauauaagaagaaa

SEQ ID NO: 2714 - RNA, 21 nt, Artificial Sequence
  Synthetic Oligonucleotide
auaugaauauaagaagaaaua

SEQ ID NO: 2715 - RNA, 21 nt, Artificial Sequence
  Synthetic Oligonucleotide
gcugacauugaaccauuucug

SEQ ID NO: 2716 - RNA, 21 nt, Artificial Sequence
  Synthetic Oligonucleotide
ugacauugaaccauuucugaa

SEQ ID NO: 2717 - RNA, 21 nt, Artificial Sequence
  Synthetic Oligonucleotide
acauugaaccauuucugaaaa

SEQ ID NO: 2718 - RNA, 21 nt, Artificial Sequence
  Synthetic Oligonucleotide
auugaaccauuucugaaaaau

SEQ ID NO: 2719 - RNA, 21 nt, Artificial Sequence
  Synthetic Oligonucleotide
ugaaccauuucugaaaaauuc

SEQ ID NO: 2720 - RNA, 21 nt, Artificial Sequence
  Synthetic Oligonucleotide
aaccauuucugaaaaauuccu

SEQ ID NO: 2721 - RNA, 21 nt, Artificial Sequence
  Synthetic Oligonucleotide
aaagaggccuucgggugauug

SEQ ID NO: 2722 - RNA, 21 nt, Artificial Sequence
  Synthetic Oligonucleotide
agaggccuucgggugauugag

SEQ ID NO: 2723 - RNA, 21 nt, Artificial Sequence
  Synthetic Oligonucleotide
aggccuucgggugauugagau

SEQ ID NO: 2724 - RNA, 21 nt, Artificial Sequence
  Synthetic Oligonucleotide
gccuucgggugauugagaugg

SEQ ID NO: 2725 - RNA, 21 nt, Artificial Sequence
  Synthetic Oligonucleotide
cuucgggugauugagauggag

SEQ ID NO: 2726 - RNA, 21 nt, Artificial Sequence
  Synthetic Oligonucleotide
ucgggugauugagauggagag

SEQ ID NO: 2727 - RNA, 21 nt, Artificial Sequence
  Synthetic Oligonucleotide
ggccaucugucuacuuggaaa

SEQ ID NO: 2728 - RNA, 21 nt, Artificial Sequence
  Synthetic Oligonucleotide
ccaucugucuacuuggaaagg

SEQ ID NO: 2729 - RNA, 21 nt, Artificial Sequence
  Synthetic Oligonucleotide
aucugucuacuuggaaaggcu

SEQ ID NO: 2730 - RNA, 21 nt, Artificial Sequence
  Synthetic Oligonucleotide
cugucuacuuggaaaggcuaa

SEQ ID NO: 2731 - RNA, 21 nt, Artificial Sequence
  Synthetic Oligonucleotide
uuugaccucuuugcucuccaa

SEQ ID NO: 2732 - RNA, 21 nt, Artificial Sequence
  Synthetic Oligonucleotide
ugaccucuuugcucuccaaac

SEQ ID NO: 2733 - RNA, 21 nt, Artificial Sequence
  Synthetic Oligonucleotide
accucuuugcucuccaaacca

SEQ ID NO: 2734 - RNA, 21 nt, Artificial Sequence
  Synthetic Oligonucleotide
cucuuugcucuccaaaccagc

SEQ ID NO: 2735 - RNA, 21 nt, Artificial Sequence
  Synthetic Oligonucleotide
ugugaccuccuccuccuccac

SEQ ID NO: 2736 - RNA, 21 nt, Artificial Sequence
  Synthetic Oligonucleotide
aaagacuggagagaauaaaga

SEQ ID NO: 2737 - RNA, 21 nt, Artificial Sequence
  Synthetic Oligonucleotide
agacuggagagaauaaagagc

SEQ ID NO: 2738 - RNA, 21 nt, Artificial Sequence
  Synthetic Oligonucleotide
acuggagagaauaaagagcag

SEQ ID NO: 2739 - RNA, 21 nt, Artificial Sequence
  Synthetic Oligonucleotide
uggagagaauaaagagcaguc

SEQ ID NO: 2740 - RNA, 21 nt, Artificial Sequence
  Synthetic Oligonucleotide
gagagaauaaagagcagucgc

SEQ ID NO: 2741 - RNA, 21 nt, Artificial Sequence
  Synthetic Oligonucleotide
gagaauaaagagcagucgcaa

SEQ ID NO: 2742 - RNA, 21 nt, Artificial Sequence
  Synthetic Oligonucleotide
gaauaaagagcagucgcaaau

SEQ ID NO: 2743 - RNA, 21 nt, Artificial Sequence
  Synthetic Oligonucleotide
auaaagagcagucgcaaauga

SEQ ID NO: 2744 - RNA, 21 nt, Artificial Sequence
  Synthetic Oligonucleotide
aaagagcagucgcaaaugaag

SEQ ID NO: 2745 - RNA, 21 nt, Artificial Sequence
  Synthetic Oligonucleotide
acaaacugguuguauguauca

SEQ ID NO: 2746 - RNA, 21 nt, Artificial Sequence
  Synthetic Oligonucleotide
ugcucauuuguaaaauugucc

SEQ ID NO: 2747 - RNA, 21 nt, Artificial Sequence
  Synthetic Oligonucleotide
cucauuuguaaaauuguccua

SEQ ID NO: 2748 - RNA, 21 nt, Artificial Sequence
  Synthetic Oligonucleotide
cauuuguaaaauuguccuaau

SEQ ID NO: 2749 - RNA, 21 nt, Artificial Sequence
  Synthetic Oligonucleotide
ucacuguauucuguaugaaug

SEQ ID NO: 2750 - RNA, 21 nt, Artificial Sequence
  Synthetic Oligonucleotide
acuguauucuguaugaaugca

SEQ ID NO: 2751 - RNA, 21 nt, Artificial Sequence
  Synthetic Oligonucleotide
uguauucuguaugaaugcaug

SEQ ID NO: 2752 - RNA, 21 nt, Artificial Sequence
  Synthetic Oligonucleotide
uauucuguaugaaugcauggc

SEQ ID NO: 2753 - RNA, 21 nt, Artificial Sequence
  Synthetic Oligonucleotide
uucuguaugaaugcauggcau

SEQ ID NO: 2754 - RNA, 21 nt, Artificial Sequence
  Synthetic Oligonucleotide
cuguaugaaugcauggcauga

SEQ ID NO: 2755 - RNA, 21 nt, Artificial Sequence
  Synthetic Oligonucleotide
ucuuuuauaaauaaaguuugc

SEQ ID NO: 2756 - RNA, 21 nt, Artificial Sequence
  Synthetic Oligonucleotide
uuuuauaaauaaaguuugcau

SEQ ID NO: 2757 - RNA, 21 nt, Artificial Sequence
  Synthetic Oligonucleotide
uuauaaauaaaguuugcauua

SEQ ID NO: 2758 - RNA, 21 nt, Artificial Sequence
  Synthetic Oligonucleotide
auaaauaaaguuugcauuaac

SEQ ID NO: 2759 - RNA, 21 nt, Artificial Sequence
  Synthetic Oligonucleotide
aaauaaaguuugcauuaacua

SEQ ID NO: 2760 - RNA, 21 nt, Artificial Sequence
  Synthetic Oligonucleotide
auaaaguuugcauuaacuaua

SEQ ID NO: 2761 - RNA, 21 nt, Artificial Sequence
  Synthetic Oligonucleotide
cccagcugaggaaauacucuu

SEQ ID NO: 2762 - RNA, 21 nt, Artificial Sequence
  Synthetic Oligonucleotide
gguugaaacugccaguugauc

SEQ ID NO: 2763 - RNA, 21 nt, Artificial Sequence
  Synthetic Oligonucleotide
cugccaguugaucagaaaugu

SEQ ID NO: 2764 - RNA, 21 nt, Artificial Sequence
  Synthetic Oligonucleotide
uggaaagcaagguuaaguggg

SEQ ID NO: 2765 - RNA, 21 nt, Artificial Sequence
  Synthetic Oligonucleotide
cccagagugguccaaauuuuu

SEQ ID NO: 2766 - RNA, 21 nt, Artificial Sequence
  Synthetic Oligonucleotide
cagugguucaauugaaaggau

SEQ ID NO: 2767 - RNA, 21 nt, Artificial Sequence
  Synthetic Oligonucleotide
aggauuagaagcugcacuugu

SEQ ID NO: 2768 - RNA, 21 nt, Artificial Sequence
  Synthetic Oligonucleotide
agcugcacuuguuuauguuga

SEQ ID NO: 2769 - RNA, 21 nt, Artificial Sequence
  Synthetic Oligonucleotide
agcaggaaaaaccacaggaga

SEQ ID NO: 2770 - RNA, 21 nt, Artificial Sequence
  Synthetic Oligonucleotide
gucagguguuguaaguaaggu

SEQ ID NO: 2771 - RNA, 21 nt, Artificial Sequence
  Synthetic Oligonucleotide
guguuguaaguaagguguuca

SEQ ID NO: 2772 - RNA, 21 nt, Artificial Sequence
  Synthetic Oligonucleotide
guucaaucaaccuaaagcuaa

SEQ ID NO: 2773 - RNA, 21 nt, Artificial Sequence
  Synthetic Oligonucleotide
cuccugaaaggcuuggacaau

SEQ ID NO: 2774 - RNA, 21 nt, Artificial Sequence
  Synthetic Oligonucleotide
uuaagccaauuaucaaagugu

SEQ ID NO: 2775 - RNA, 21 nt, Artificial Sequence
  Synthetic Oligonucleotide
ucaaaguguugccaaaacucu

SEQ ID NO: 2776 - RNA, 21 nt, Artificial Sequence
  Synthetic Oligonucleotide
gccaaaacucuuugagucucg

SEQ ID NO: 2777 - RNA, 21 nt, Artificial Sequence
  Synthetic Oligonucleotide
ggcuguucgagaugaagccaa

SEQ ID NO: 2778 - RNA, 21 nt, Artificial Sequence
  Synthetic Oligonucleotide
cccauuacaaaauauaaacuc

SEQ ID NO: 2779 - RNA, 21 nt, Artificial Sequence
  Synthetic Oligonucleotide
acaaaauauaaacucuguuca

SEQ ID NO: 2780 - RNA, 21 nt, Artificial Sequence
  Synthetic Oligonucleotide
auauaaacucuguucaguuga

SEQ ID NO: 2781 - RNA, 21 nt, Artificial Sequence
  Synthetic Oligonucleotide
cucuguucaguugaaagaacu

SEQ ID NO: 2782 - RNA, 21 nt, Artificial Sequence
  Synthetic Oligonucleotide
gugaugaggugccacaaauag

SEQ ID NO: 2783 - RNA, 21 nt, Artificial Sequence
  Synthetic Oligonucleotide
acaaauagaugcuuaugagcu

SEQ ID NO: 2784 - RNA, 21 nt, Artificial Sequence
  Synthetic Oligonucleotide
uuaugagcuuuuagaagcugu

SEQ ID NO: 2785 - RNA, 21 nt, Artificial Sequence
  Synthetic Oligonucleotide
ggcccuggagucuguagaagu

SEQ ID NO: 2786 - RNA, 21 nt, Artificial Sequence
  Synthetic Oligonucleotide
uggagucuguagaaguacuaa

SEQ ID NO: 2787 - RNA, 21 nt, Artificial Sequence
  Synthetic Oligonucleotide
ugcagauuuaguaaaagcauu

SEQ ID NO: 2788 - RNA, 21 nt, Artificial Sequence
  Synthetic Oligonucleotide
guaaaagcauuaaagaagguu

SEQ ID NO: 2789 - RNA, 21 nt, Artificial Sequence
  Synthetic Oligonucleotide
agcauuaaagaagguuguugg

SEQ ID NO: 2790 - RNA, 21 nt, Artificial Sequence
  Synthetic Oligonucleotide
aagaagguuguuggaaaggac

SEQ ID NO: 2791 - RNA, 21 nt, Artificial Sequence
  Synthetic Oligonucleotide
aaggaagaaauuuggacaaua

SEQ ID NO: 2792 - RNA, 21 nt, Artificial Sequence
  Synthetic Oligonucleotide
cagugaggauguuuuagcagu

SEQ ID NO: 2793 - RNA, 21 nt, Artificial Sequence
  Synthetic Oligonucleotide
auguuuuagcaguaauggaua

SEQ ID NO: 2794 - RNA, 21 nt, Artificial Sequence
  Synthetic Oligonucleotide
aucaagcagcagacaucucuu

SEQ ID NO: 2795 - RNA, 21 nt, Artificial Sequence
  Synthetic Oligonucleotide
cagacaucucuuuuuauugca

SEQ ID NO: 2796 - RNA, 21 nt, Artificial Sequence
  Synthetic Oligonucleotide
agucagagaugccgcauuuga

SEQ ID NO: 2797 - RNA, 21 nt, Artificial Sequence
  Synthetic Oligonucleotide
agcauuggguacugcuuugaa

SEQ ID NO: 2798 - RNA, 21 nt, Artificial Sequence
  Synthetic Oligonucleotide
auguggacaaacucaagcuug

SEQ ID NO: 2799 - RNA, 21 nt, Artificial Sequence
  Synthetic Oligonucleotide
caaagaauguucagaaaaggu

SEQ ID NO: 2800 - RNA, 21 nt, Artificial Sequence
  Synthetic Oligonucleotide
guucagaaaagguagaacuga

SEQ ID NO: 2801 - RNA, 21 nt, Artificial Sequence
  Synthetic Oligonucleotide
aagguagaacugauacauggu

SEQ ID NO: 2802 - RNA, 21 nt, Artificial Sequence
  Synthetic Oligonucleotide
cgcagggaauacuggaaccaa

SEQ ID NO: 2803 - RNA, 21 nt, Artificial Sequence
  Synthetic Oligonucleotide
agccugagcucucgauagaag

SEQ ID NO: 2804 - RNA, 21 nt, Artificial Sequence
  Synthetic Oligonucleotide
cucgauagaaguaugugaaga

SEQ ID NO: 2805 - RNA, 21 nt, Artificial Sequence
  Synthetic Oligonucleotide
uucuugacagcaguaacugga

SEQ ID NO: 2806 - RNA, 21 nt, Artificial Sequence
  Synthetic Oligonucleotide
gagcuaauggaccgaacugaa

SEQ ID NO: 2807 - RNA, 21 nt, Artificial Sequence
  Synthetic Oligonucleotide
cauuagugaggaugcuagcca

SEQ ID NO: 2808 - RNA, 21 nt, Artificial Sequence
  Synthetic Oligonucleotide
uagccaagaaaccuggaugga

SEQ ID NO: 2809 - RNA, 21 nt, Artificial Sequence
  Synthetic Oligonucleotide
aagaaaccuggauggaaagaa

SEQ ID NO: 2810 - RNA, 21 nt, Artificial Sequence
  Synthetic Oligonucleotide
aggugaugcaaaugaagcuuc

SEQ ID NO: 2811 - RNA, 21 nt, Artificial Sequence
  Synthetic Oligonucleotide
caaaacgucagcucagguugu

SEQ ID NO: 2812 - RNA, 21 nt, Artificial Sequence
  Synthetic Oligonucleotide
ugcaaaagaagcuaugacagc

SEQ ID NO: 2813 - RNA, 21 nt, Artificial Sequence
  Synthetic Oligonucleotide
gacagcaauagccgaagccug

SEQ ID NO: 2814 - RNA, 21 nt, Artificial Sequence
  Synthetic Oligonucleotide
ccgaagccuguauguuaccau

SEQ ID NO: 2815 - RNA, 21 nt, Artificial Sequence
  Synthetic Oligonucleotide
caaaaaucagucagaaacucu

SEQ ID NO: 2816 - RNA, 21 nt, Artificial Sequence
  Synthetic Oligonucleotide
aaagcuuucauuagcaaugug

SEQ ID NO: 2817 - RNA, 21 nt, Artificial Sequence
  Synthetic Oligonucleotide
uugagaagaugcagggacaaa

SEQ ID NO: 2818 - RNA, 21 nt, Artificial Sequence
  Synthetic Oligonucleotide
gagcaaugaugucguugaucu

SEQ ID NO: 2819 - RNA, 21 nt, Artificial Sequence
  Synthetic Oligonucleotide
augaaguggcagguauuauua

SEQ ID NO: 2820 - RNA, 21 nt, Artificial Sequence
  Synthetic Oligonucleotide
cugccuugaagggucgacuca

SEQ ID NO: 2821 - RNA, 21 nt, Artificial Sequence
  Synthetic Oligonucleotide
uugaagggucgacucaaugau

SEQ ID NO: 2822 - RNA, 21 nt, Artificial Sequence
  Synthetic Oligonucleotide
ucgacucaaugauucaaauaa

SEQ ID NO: 2823 - RNA, 21 nt, Artificial Sequence
  Synthetic Oligonucleotide
caaugauucaaauaaaaucuu

SEQ ID NO: 2824 - RNA, 21 nt, Artificial Sequence
  Synthetic Oligonucleotide
guagccaugggcccaaauauu

SEQ ID NO: 2825 - RNA, 21 nt, Artificial Sequence
  Synthetic Oligonucleotide
ccaaauauuaagcaacaugua

SEQ ID NO: 2826 - RNA, 21 nt, Artificial Sequence
  Synthetic Oligonucleotide
guccuuggagacagcaagaac

SEQ ID NO: 2827 - RNA, 21 nt, Artificial Sequence
  Synthetic Oligonucleotide
uggagacagcaagaacaaugu

SEQ ID NO: 2828 - RNA, 21 nt, Artificial Sequence
  Synthetic Oligonucleotide
uucaugaugcauuuaggauau

SEQ ID NO: 2829 - RNA, 21 nt, Artificial Sequence
  Synthetic Oligonucleotide
ugcuagagaaagccaaaguua

SEQ ID NO: 2830 - RNA, 21 nt, Artificial Sequence
  Synthetic Oligonucleotide
aagggaagaagaugccaagca

SEQ ID NO: 2831 - RNA, 21 nt, Artificial Sequence
  Synthetic Oligonucleotide
uggaaaagagcaaaggaugaa

SEQ ID NO: 2832 - RNA, 21 nt, Artificial Sequence
  Synthetic Oligonucleotide
aagagcaaaggaugaaagaug

SEQ ID NO: 2833 - RNA, 21 nt, Artificial Sequence
  Synthetic Oligonucleotide
acgggaugaauacauugagca

SEQ ID NO: 2834 - RNA, 21 nt, Artificial Sequence
  Synthetic Oligonucleotide
augaauacauugagcaacuaa

SEQ ID NO: 2835 - RNA, 21 nt, Artificial Sequence
  Synthetic Oligonucleotide
aaaguggcuuacccugagguu

SEQ ID NO: 2836 - RNA, 21 nt, Artificial Sequence
  Synthetic Oligonucleotide
acccugagguuuuuugacacc

SEQ ID NO: 2837 - RNA, 21 nt, Artificial Sequence
  Synthetic Oligonucleotide
accaauacaagcguccugaug

SEQ ID NO: 2838 - RNA, 21 nt, Artificial Sequence
  Synthetic Oligonucleotide
gcguccugaugaaagcacuag

SEQ ID NO: 2839 - RNA, 21 nt, Artificial Sequence
  Synthetic Oligonucleotide
ugaugaaagcacuagaauauu

SEQ ID NO: 2840 - RNA, 21 nt, Artificial Sequence
  Synthetic Oligonucleotide
uggaaaucuuucugaaaagga

SEQ ID NO: 2841 - RNA, 21 nt, Artificial Sequence
  Synthetic Oligonucleotide
cugaaaaggauaugagcaugc

SEQ ID NO: 2842 - RNA, 21 nt, Artificial Sequence
  Synthetic Oligonucleotide
aagcuccaaugccaacauguu

SEQ ID NO: 2843 - RNA, 21 nt, Artificial Sequence
  Synthetic Oligonucleotide
ccaaugccaacauguuacgca

SEQ ID NO: 2844 - RNA, 21 nt, Artificial Sequence
  Synthetic Oligonucleotide
augugaaaugccagaacuugu

SEQ ID NO: 2845 - RNA, 21 nt, Artificial Sequence
  Synthetic Oligonucleotide
gccagaacuuguucagcacaa

SEQ ID NO: 2846 - RNA, 21 nt, Artificial Sequence
  Synthetic Oligonucleotide
gcacaaacuggaugacauuuu

SEQ ID NO: 2847 - RNA, 21 nt, Artificial Sequence
  Synthetic Oligonucleotide
uggaugacauuuuugagccag

SEQ ID NO: 2848 - RNA, 21 nt, Artificial Sequence
  Synthetic Oligonucleotide
gacauuuuugagccaguccuu

SEQ ID NO: 2849 - RNA, 21 nt, Artificial Sequence
  Synthetic Oligonucleotide
uugagccaguccuuauuccug

SEQ ID NO: 2850 - RNA, 21 nt, Artificial Sequence
  Synthetic Oligonucleotide
cacuggaguacuaaaagaccu

SEQ ID NO: 2851 - RNA, 21 nt, Artificial Sequence
  Synthetic Oligonucleotide
uggugaagguucuggagaagu

SEQ ID NO: 2852 - RNA, 21 nt, Artificial Sequence
  Synthetic Oligonucleotide
auccugagugcccuacuuguu

SEQ ID NO: 2853 - RNA, 21 nt, Artificial Sequence
  Synthetic Oligonucleotide
aacagccaguucucccaaauu

SEQ ID NO: 2854 - RNA, 21 nt, Artificial Sequence
  Synthetic Oligonucleotide
gagcuuguuaugaagugucuc

SEQ ID NO: 2855 - RNA, 21 nt, Artificial Sequence
  Synthetic Oligonucleotide
uucgacuguugccugauacca

SEQ ID NO: 2856 - RNA, 21 nt, Artificial Sequence
  Synthetic Oligonucleotide
cuguugccugauaccaucaau

SEQ ID NO: 2857 - RNA, 21 nt, Artificial Sequence
  Synthetic Oligonucleotide
gccugauaccaucaauagcau

SEQ ID NO: 2858 - RNA, 21 nt, Artificial Sequence
  Synthetic Oligonucleotide
ccaucaauagcauuaaccuag

SEQ ID NO: 2859 - RNA, 21 nt, Artificial Sequence
  Synthetic Oligonucleotide
aauagcauuaaccuagacaga

SEQ ID NO: 2860 - RNA, 21 nt, Artificial Sequence
  Synthetic Oligonucleotide
cagaauucuucuggauaucca

SEQ ID NO: 2861 - RNA, 21 nt, Artificial Sequence
  Synthetic Oligonucleotide
uucuggauauccacauuuuca

SEQ ID NO: 2862 - RNA, 21 nt, Artificial Sequence
  Synthetic Oligonucleotide
ccaaagagaaacugaagcaau

SEQ ID NO: 2863 - RNA, 21 nt, Artificial Sequence
  Synthetic Oligonucleotide
gagaaacugaagcaaugcaaa

SEQ ID NO: 2864 - RNA, 21 nt, Artificial Sequence
  Synthetic Oligonucleotide
gccggaugaugaagcacagua

SEQ ID NO: 2865 - RNA, 21 nt, Artificial Sequence
  Synthetic Oligonucleotide
aacagaaaagggagcaucucg

SEQ ID NO: 2866 - RNA, 21 nt, Artificial Sequence
  Synthetic Oligonucleotide
aaagggagcaucucgaauaga

SEQ ID NO: 2867 - RNA, 21 nt, Artificial Sequence
  Synthetic Oligonucleotide
gagcaucucgaauagaugaaa

SEQ ID NO: 2868 - RNA, 21 nt, Artificial Sequence
  Synthetic Oligonucleotide
aagagggacuagcagaguuau

SEQ ID NO: 2869 - RNA, 21 nt, Artificial Sequence
  Synthetic Oligonucleotide
auacucagaugcugacauuga

SEQ ID NO: 2870 - RNA, 21 nt, Artificial Sequence
  Synthetic Oligonucleotide
agcauucagaccuggauucua

SEQ ID NO: 2871 - RNA, 21 nt, Artificial Sequence
  Synthetic Oligonucleotide
cagaccuggauucuaaccaga

SEQ ID NO: 2872 - RNA, 21 nt, Artificial Sequence
  Synthetic Oligonucleotide
cuggauucuaaccagacucac

SEQ ID NO: 2873 - RNA, 21 nt, Artificial Sequence
  Synthetic Oligonucleotide
cagcuaacauagacgacuuga

SEQ ID NO: 2874 - RNA, 21 nt, Artificial Sequence
  Synthetic Oligonucleotide
aacauagacgacuugaaaaaa

SEQ ID NO: 2875 - RNA, 21 nt, Artificial Sequence
  Synthetic Oligonucleotide
aacuagaaguccucauaguuu

SEQ ID NO: 2876 - RNA, 21 nt, Artificial Sequence
  Synthetic Oligonucleotide
uggaugaguuuaguguacaga

SEQ ID NO: 2877 - RNA, 21 nt, Artificial Sequence
  Synthetic Oligonucleotide
cccagauccuuuucuuuucuu

SEQ ID NO: 2878 - RNA, 21 nt, Artificial Sequence
  Synthetic Oligonucleotide
auugcucauuuguaaaauugu

SEQ ID NO: 2879 - RNA, 21 nt, Artificial Sequence
  Synthetic Oligonucleotide
cugaagggucacuguauucug

SEQ ID NO: 2880 - RNA, 21 nt, Artificial Sequence
  Synthetic Oligonucleotide
gggucacuguauucuguauga

SEQ ID NO: 2881 - RNA, 27 nt, Artificial Sequence
  Synthetic Oligonucleotide
uggaagcacaaugggagaugacaguac

SEQ ID NO: 2882 - RNA, 27 nt, Artificial Sequence
  Synthetic Oligonucleotide
gaagcacaaugggagaugacagugaac

SEQ ID NO: 2883 - RNA, 27 nt, Artificial Sequence
  Synthetic Oligonucleotide
agcacaaugggagaugacagugaguaa

SEQ ID NO: 2884 - RNA, 27 nt, Artificial Sequence
  Synthetic Oligonucleotide
cacaaugggagaugacagugaguggcc

SEQ ID NO: 2885 - RNA, 27 nt, Artificial Sequence
  Synthetic Oligonucleotide
caaugggagaugacagugagugguuac

SEQ ID NO: 2886 - RNA, 27 nt, Artificial Sequence
  Synthetic Oligonucleotide
augggagaugacagugagugguugacc

SEQ ID NO: 2887 - RNA, 27 nt, Artificial Sequence
  Synthetic Oligonucleotide
gggagaugacagugagugguugaaaac

SEQ ID NO: 2888 - RNA, 27 nt, Artificial Sequence
  Synthetic Oligonucleotide
gagaugacagugagugguugaaacuaa

SEQ ID NO: 2889 - RNA, 27 nt, Artificial Sequence
  Synthetic Oligonucleotide
gaugacagugagugguugaaacugcac

SEQ ID NO: 2890 - RNA, 27 nt, Artificial Sequence
  Synthetic Oligonucleotide
cugaagaucuuccagaaaauaaaggcc

SEQ ID NO: 2891 - RNA, 27 nt, Artificial Sequence
  Synthetic Oligonucleotide
gaagaucuuccagaaaauaaaggauac

SEQ ID NO: 2892 - RNA, 27 nt, Artificial Sequence
  Synthetic Oligonucleotide
agaucuuccagaaaauaaaggaugacc

SEQ ID NO: 2893 - RNA, 27 nt, Artificial Sequence
  Synthetic Oligonucleotide
aucuuccagaaaauaaaggaugaaaca

SEQ ID NO: 2894 - RNA, 27 nt, Artificial Sequence
  Synthetic Oligonucleotide
cuuccagaaaauaaaggaugaaaagca

SEQ ID NO: 2895 - RNA, 27 nt, Artificial Sequence
  Synthetic Oligonucleotide
uccagaaaauaaaggaugaaaagagaa

SEQ ID NO: 2896 - RNA, 27 nt, Artificial Sequence
  Synthetic Oligonucleotide
cagaaaauaaaggaugaaaagagccac

SEQ ID NO: 2897 - RNA, 27 nt, Artificial Sequence
  Synthetic Oligonucleotide
gaaaauaaaggaugaaaagagcccaac

SEQ ID NO: 2898 - RNA, 27 nt, Artificial Sequence
  Synthetic Oligonucleotide
gaucaaaaaauuugucacugauucccc

SEQ ID NO: 2899 - RNA, 27 nt, Artificial Sequence
  Synthetic Oligonucleotide
ucaaaaaauuugucacugauuccaaca

SEQ ID NO: 2900 - RNA, 27 nt, Artificial Sequence
  Synthetic Oligonucleotide
aaaaaauuugucacugauuccaaugac

SEQ ID NO: 2901 - RNA, 27 nt, Artificial Sequence
  Synthetic Oligonucleotide
aaaauuugucacugauuccaaugcaac

SEQ ID NO: 2902 - RNA, 27 nt, Artificial Sequence
  Synthetic Oligonucleotide
aauuugucacugauuccaaugcaguaa

SEQ ID NO: 2903 - RNA, 27 nt, Artificial Sequence
  Synthetic Oligonucleotide
uuugucacugauuccaaugcaguggcc

SEQ ID NO: 2904 - RNA, 27 nt, Artificial Sequence
  Synthetic Oligonucleotide
ugucacugauuccaaugcagugguuac

SEQ ID NO: 2905 - RNA, 27 nt, Artificial Sequence
  Synthetic Oligonucleotide
ucacugauuccaaugcagugguucacc

SEQ ID NO: 2906 - RNA, 27 nt, Artificial Sequence
  Synthetic Oligonucleotide
acugauuccaaugcagugguucaauca

SEQ ID NO: 2907 - RNA, 27 nt, Artificial Sequence
  Synthetic Oligonucleotide
ugauuccaaugcagugguucaauugcc

SEQ ID NO: 2908 - RNA, 27 nt, Artificial Sequence
  Synthetic Oligonucleotide
auuccaaugcagugguucaauugaaca

SEQ ID NO: 2909 - RNA, 27 nt, Artificial Sequence
  Synthetic Oligonucleotide
uccaaugcagugguucaauugaaagac

SEQ ID NO: 2910 - RNA, 27 nt, Artificial Sequence
  Synthetic Oligonucleotide
caaugcagugguucaauugaaaggacc

SEQ ID NO: 2911 - RNA, 27 nt, Artificial Sequence
  Synthetic Oligonucleotide
augcagugguucaauugaaaggauuca

SEQ ID NO: 2912 - RNA, 27 nt, Artificial Sequence
  Synthetic Oligonucleotide
gcagugguucaauugaaaggauuagcc

SEQ ID NO: 2913 - RNA, 27 nt, Artificial Sequence
  Synthetic Oligonucleotide
ccaagaucauaguggccuguauagaac

SEQ ID NO: 2914 - RNA, 27 nt, Artificial Sequence
  Synthetic Oligonucleotide
aagaucauaguggccuguauagagaac

SEQ ID NO: 2915 - RNA, 27 nt, Artificial Sequence
  Synthetic Oligonucleotide
gaucauaguggccuguauagagacaac

SEQ ID NO: 2916 - RNA, 27 nt, Artificial Sequence
  Synthetic Oligonucleotide
gacacugaggaaagccuuaagugaacc

SEQ ID NO: 2917 - RNA, 27 nt, Artificial Sequence
  Synthetic Oligonucleotide
cacugaggaaagccuuaagugaauuca

SEQ ID NO: 2918 - RNA, 27 nt, Artificial Sequence
  Synthetic Oligonucleotide
cugaggaaagccuuaagugaauuugac

SEQ ID NO: 2919 - RNA, 27 nt, Artificial Sequence
  Synthetic Oligonucleotide
gaggaaagccuuaagugaauuugguca

SEQ ID NO: 2920 - RNA, 27 nt, Artificial Sequence
  Synthetic Oligonucleotide
ggaaagccuuaagugaauuugguucac

SEQ ID NO: 2921 - RNA, 27 nt, Artificial Sequence
  Synthetic Oligonucleotide
aaagccuuaagugaauuugguuccacc

SEQ ID NO: 2922 - RNA, 27 nt, Artificial Sequence
  Synthetic Oligonucleotide
agccuuaagugaauuugguuccaaacc

SEQ ID NO: 2923 - RNA, 27 nt, Artificial Sequence
  Synthetic Oligonucleotide
ccuuaagugaauuugguuccaaaauac

SEQ ID NO: 2924 - RNA, 27 nt, Artificial Sequence
  Synthetic Oligonucleotide
uuaagugaauuugguuccaaaaucaca

SEQ ID NO: 2925 - RNA, 27 nt, Artificial Sequence
  Synthetic Oligonucleotide
aagugaauuugguuccaaaaucauccc

SEQ ID NO: 2926 - RNA, 27 nt, Artificial Sequence
  Synthetic Oligonucleotide
gugaauuugguuccaaaaucaucuuaa

SEQ ID NO: 2927 - RNA, 27 nt, Artificial Sequence
  Synthetic Oligonucleotide
gaauuugguuccaaaaucaucuugccc

SEQ ID NO: 2928 - RNA, 27 nt, Artificial Sequence
  Synthetic Oligonucleotide
uucguucccaacaagaacuagaagccc

SEQ ID NO: 2929 - RNA, 27 nt, Artificial Sequence
  Synthetic Oligonucleotide
cguucccaacaagaacuagaagcuacc

SEQ ID NO: 2930 - RNA, 27 nt, Artificial Sequence
  Synthetic Oligonucleotide
uucccaacaagaacuagaagcuaaacc

SEQ ID NO: 2931 - RNA, 27 nt, Artificial Sequence
  Synthetic Oligonucleotide
cccaacaagaacuagaagcuaaauuaa

SEQ ID NO: 2932 - RNA, 27 nt, Artificial Sequence
  Synthetic Oligonucleotide
caacaagaacuagaagcuaaauuggcc

SEQ ID NO: 2933 - RNA, 27 nt, Artificial Sequence
  Synthetic Oligonucleotide
acaacagucugcugguggagaugcuac

SEQ ID NO: 2934 - RNA, 27 nt, Artificial Sequence
  Synthetic Oligonucleotide
aacagucugcugguggagaugcugaca

SEQ ID NO: 2935 - RNA, 27 nt, Artificial Sequence
  Synthetic Oligonucleotide
agguggugaugauggugaugaggugaa

SEQ ID NO: 2936 - RNA, 27 nt, Artificial Sequence
  Synthetic Oligonucleotide
guggugaugauggugaugaggugccca

SEQ ID NO: 2937 - RNA, 27 nt, Artificial Sequence
  Synthetic Oligonucleotide
aaauccuuuccaaacuucccaaagaac

SEQ ID NO: 2938 - RNA, 27 nt, Artificial Sequence
  Synthetic Oligonucleotide
auccuuuccaaacuucccaaagacucc

SEQ ID NO: 2939 - RNA, 27 nt, Artificial Sequence
  Synthetic Oligonucleotide
ccuuuccaaacuucccaaagacuuucc

SEQ ID NO: 2940 - RNA, 27 nt, Artificial Sequence
  Synthetic Oligonucleotide
uuuccaaacuucccaaagacuuuuaca

SEQ ID NO: 2941 - RNA, 27 nt, Artificial Sequence
  Synthetic Oligonucleotide
uccaaacuucccaaagacuuuuaugca

SEQ ID NO: 2942 - RNA, 27 nt, Artificial Sequence
  Synthetic Oligonucleotide
caaacuucccaaagacuuuuaugaccc

SEQ ID NO: 2943 - RNA, 27 nt, Artificial Sequence
  Synthetic Oligonucleotide
aacuucccaaagacuuuuaugacaacc

SEQ ID NO: 2944 - RNA, 27 nt, Artificial Sequence
  Synthetic Oligonucleotide
cuucccaaagacuuuuaugacaaaacc

SEQ ID NO: 2945 - RNA, 27 nt, Artificial Sequence
  Synthetic Oligonucleotide
ucccaaagacuuuuaugacaaaauuac

SEQ ID NO: 2946 - RNA, 27 nt, Artificial Sequence
  Synthetic Oligonucleotide
ccaaagacuuuuaugacaaaauugaaa

SEQ ID NO: 2947 - RNA, 27 nt, Artificial Sequence
  Synthetic Oligonucleotide
aaagacuuuuaugacaaaauugaggac

SEQ ID NO: 2948 - RNA, 27 nt, Artificial Sequence
  Synthetic Oligonucleotide
agacuuuuaugacaaaauugaggcacc

SEQ ID NO: 2949 - RNA, 27 nt, Artificial Sequence
  Synthetic Oligonucleotide
acuuuuaugacaaaauugaggcaaacc

SEQ ID NO: 2950 - RNA, 27 nt, Artificial Sequence
  Synthetic Oligonucleotide
uuuuaugacaaaauugaggcaaaaacc

SEQ ID NO: 2951 - RNA, 27 nt, Artificial Sequence
  Synthetic Oligonucleotide
uuaugacaaaauugaggcaaaaaaaca

SEQ ID NO: 2952 - RNA, 27 nt, Artificial Sequence
  Synthetic Oligonucleotide
aaaauggcaagagagaaaagaggccac

SEQ ID NO: 2953 - RNA, 27 nt, Artificial Sequence
  Synthetic Oligonucleotide
gaagguuguuggaaaggacaccaauac

SEQ ID NO: 2954 - RNA, 27 nt, Artificial Sequence
  Synthetic Oligonucleotide
agguuguuggaaaggacaccaauguac

SEQ ID NO: 2955 - RNA, 27 nt, Artificial Sequence
  Synthetic Oligonucleotide
guuguuggaaaggacaccaaugucaca

SEQ ID NO: 2956 - RNA, 27 nt, Artificial Sequence
  Synthetic Oligonucleotide
uguuggaaaggacaccaaugucaugcc

SEQ ID NO: 2957 - RNA, 27 nt, Artificial Sequence
  Synthetic Oligonucleotide
uuggaaaggacaccaaugucauguuaa

SEQ ID NO: 2958 - RNA, 27 nt, Artificial Sequence
  Synthetic Oligonucleotide
ggaaaggacaccaaugucauguuggca

SEQ ID NO: 2959 - RNA, 27 nt, Artificial Sequence
  Synthetic Oligonucleotide
aaaggacaccaaugucauguuggugaa

SEQ ID NO: 2960 - RNA, 27 nt, Artificial Sequence
  Synthetic Oligonucleotide
aggacaccaaugucauguugguggccc

SEQ ID NO: 2961 - RNA, 27 nt, Artificial Sequence
  Synthetic Oligonucleotide
uggcuuuggcagcaaaaugucuuacca

SEQ ID NO: 2962 - RNA, 27 nt, Artificial Sequence
  Synthetic Oligonucleotide
gcuuuggcagcaaaaugucuuacugaa

SEQ ID NO: 2963 - RNA, 27 nt, Artificial Sequence
  Synthetic Oligonucleotide
uuuggcagcaaaaugucuuacuggcac

SEQ ID NO: 2964 - RNA, 27 nt, Artificial Sequence
  Synthetic Oligonucleotide
uggcagcaaaaugucuuacuggccuaa

SEQ ID NO: 2965 - RNA, 27 nt, Artificial Sequence
  Synthetic Oligonucleotide
gcagcaaaaugucuuacuggccuggac

SEQ ID NO: 2966 - RNA, 27 nt, Artificial Sequence
  Synthetic Oligonucleotide
gaagaaauuuggacaauaugcaggaac

SEQ ID NO: 2967 - RNA, 27 nt, Artificial Sequence
  Synthetic Oligonucleotide
agaaauuuggacaauaugcaggacaca

SEQ ID NO: 2968 - RNA, 27 nt, Artificial Sequence
  Synthetic Oligonucleotide
aaauuuggacaauaugcaggacaugcc

SEQ ID NO: 2969 - RNA, 27 nt, Artificial Sequence
  Synthetic Oligonucleotide
auuuggacaauaugcaggacauguuac

SEQ ID NO: 2970 - RNA, 27 nt, Artificial Sequence
  Synthetic Oligonucleotide
uuggacaauaugcaggacauguuguaa

SEQ ID NO: 2971 - RNA, 27 nt, Artificial Sequence
  Synthetic Oligonucleotide
ggacaauaugcaggacauguugugcac

SEQ ID NO: 2972 - RNA, 27 nt, Artificial Sequence
  Synthetic Oligonucleotide
acaauaugcaggacauguugugccaca

SEQ ID NO: 2973 - RNA, 27 nt, Artificial Sequence
  Synthetic Oligonucleotide
aauaugcaggacauguugugccaacac

SEQ ID NO: 2974 - RNA, 27 nt, Artificial Sequence
  Synthetic Oligonucleotide
uaugcaggacauguugugccaaccaca

SEQ ID NO: 2975 - RNA, 27 nt, Artificial Sequence
  Synthetic Oligonucleotide
ugcaggacauguugugccaaccauccc

SEQ ID NO: 2976 - RNA, 27 nt, Artificial Sequence
  Synthetic Oligonucleotide
accucaagugguacaagcccugcagac

SEQ ID NO: 2977 - RNA, 27 nt, Artificial Sequence
  Synthetic Oligonucleotide
cucaagugguacaagcccugcaggaaa

SEQ ID NO: 2978 - RNA, 27 nt, Artificial Sequence
  Synthetic Oligonucleotide
caagugguacaagcccugcaggaggac

SEQ ID NO: 2979 - RNA, 27 nt, Artificial Sequence
  Synthetic Oligonucleotide
agugguacaagcccugcaggaggcacc

SEQ ID NO: 2980 - RNA, 27 nt, Artificial Sequence
  Synthetic Oligonucleotide
ugguacaagcccugcaggaggcaauca

SEQ ID NO: 2981 - RNA, 27 nt, Artificial Sequence
  Synthetic Oligonucleotide
guacaagcccugcaggaggcaauugcc

SEQ ID NO: 2982 - RNA, 27 nt, Artificial Sequence
  Synthetic Oligonucleotide
acaagcccugcaggaggcaauugauaa

SEQ ID NO: 2983 - RNA, 27 nt, Artificial Sequence
  Synthetic Oligonucleotide
aagcccugcaggaggcaauugaugccc

SEQ ID NO: 2984 - RNA, 27 nt, Artificial Sequence
  Synthetic Oligonucleotide
gcccugcaggaggcaauugaugcaaca

SEQ ID NO: 2985 - RNA, 27 nt, Artificial Sequence
  Synthetic Oligonucleotide
ccugcaggaggcaauugaugcaauccc

SEQ ID NO: 2986 - RNA, 27 nt, Artificial Sequence
  Synthetic Oligonucleotide
ugcaggaggcaauugaugcaaucuuaa

SEQ ID NO: 2987 - RNA, 27 nt, Artificial Sequence
  Synthetic Oligonucleotide
caggaggcaauugaugcaaucuucccc

SEQ ID NO: 2988 - RNA, 27 nt, Artificial Sequence
  Synthetic Oligonucleotide
ggaggcaauugaugcaaucuuccuuca

SEQ ID NO: 2989 - RNA, 27 nt, Artificial Sequence
  Synthetic Oligonucleotide
aggcaauugaugcaaucuuccuuaccc

SEQ ID NO: 2990 - RNA, 27 nt, Artificial Sequence
  Synthetic Oligonucleotide
uuacuaccacacuacagaacaucagca

SEQ ID NO: 2991 - RNA, 27 nt, Artificial Sequence
  Synthetic Oligonucleotide
acuaccacacuacagaacaucagugca

SEQ ID NO: 2992 - RNA, 27 nt, Artificial Sequence
  Synthetic Oligonucleotide
uaccacacuacagaacaucagugagac

SEQ ID NO: 2993 - RNA, 27 nt, Artificial Sequence
  Synthetic Oligonucleotide
ccacacuacagaacaucagugaggaca

SEQ ID NO: 2994 - RNA, 27 nt, Artificial Sequence
  Synthetic Oligonucleotide
acacuacagaacaucagugaggaugcc

SEQ ID NO: 2995 - RNA, 27 nt, Artificial Sequence
  Synthetic Oligonucleotide
acuacagaacaucagugaggauguucc

SEQ ID NO: 2996 - RNA, 27 nt, Artificial Sequence
  Synthetic Oligonucleotide
uacagaacaucagugaggauguuuuca

SEQ ID NO: 2997 - RNA, 27 nt, Artificial Sequence
  Synthetic Oligonucleotide
uuuuagcaguaauggauaauaaaaaca

SEQ ID NO: 2998 - RNA, 27 nt, Artificial Sequence
  Synthetic Oligonucleotide
uuagcaguaauggauaauaaaaaucac

SEQ ID NO: 2999 - RNA, 27 nt, Artificial Sequence
  Synthetic Oligonucleotide
agcaguaauggauaauaaaaauccaca

SEQ ID NO: 3000 - RNA, 27 nt, Artificial Sequence
  Synthetic Oligonucleotide
caguaauggauaauaaaaauccaacac

SEQ ID NO: 3001 - RNA, 27 nt, Artificial Sequence
  Synthetic Oligonucleotide
caaccaucaagcagcagacaucucucc

SEQ ID NO: 3002 - RNA, 27 nt, Artificial Sequence
  Synthetic Oligonucleotide
cacuacuuaagcacaucaaugauucca

SEQ ID NO: 3003 - RNA, 27 nt, Artificial Sequence
  Synthetic Oligonucleotide
cuacuuaagcacaucaaugauucugac

SEQ ID NO: 3004 - RNA, 27 nt, Artificial Sequence
  Synthetic Oligonucleotide
acuuaagcacaucaaugauucugcuaa

SEQ ID NO: 3005 - RNA, 27 nt, Artificial Sequence
  Synthetic Oligonucleotide
uuaagcacaucaaugauucugcuccca

SEQ ID NO: 3006 - RNA, 27 nt, Artificial Sequence
  Synthetic Oligonucleotide
aagcacaucaaugauucugcuccugcc

SEQ ID NO: 3007 - RNA, 27 nt, Artificial Sequence
  Synthetic Oligonucleotide
gcacaucaaugauucugcuccugaaac

SEQ ID NO: 3008 - RNA, 27 nt, Artificial Sequence
  Synthetic Oligonucleotide
acaucaaugauucugcuccugaaguac

SEQ ID NO: 3009 - RNA, 27 nt, Artificial Sequence
  Synthetic Oligonucleotide
aucaaugauucugcuccugaagucaac

SEQ ID NO: 3010 - RNA, 27 nt, Artificial Sequence
  Synthetic Oligonucleotide
caaugauucugcuccugaagucagaac

SEQ ID NO: 3011 - RNA, 27 nt, Artificial Sequence
  Synthetic Oligonucleotide
augauucugcuccugaagucagagaca

SEQ ID NO: 3012 - RNA, 27 nt, Artificial Sequence
  Synthetic Oligonucleotide
gauucugcuccugaagucagagaugaa

SEQ ID NO: 3013 - RNA, 27 nt, Artificial Sequence
  Synthetic Oligonucleotide
uucugcuccugaagucagagaugccaa

SEQ ID NO: 3014 - RNA, 27 nt, Artificial Sequence
  Synthetic Oligonucleotide
cugcuccugaagucagagaugccgccc

SEQ ID NO: 3015 - RNA, 27 nt, Artificial Sequence
  Synthetic Oligonucleotide
aagaucaaagaauguucagaaaaggcc

SEQ ID NO: 3016 - RNA, 27 nt, Artificial Sequence
  Synthetic Oligonucleotide
gaucaaagaauguucagaaaagguaac

SEQ ID NO: 3017 - RNA, 27 nt, Artificial Sequence
  Synthetic Oligonucleotide
gaaaccuggauggaaagaaacuaaucc

SEQ ID NO: 3018 - RNA, 27 nt, Artificial Sequence
  Synthetic Oligonucleotide
aaccuggauggaaagaaacuaauuuca

SEQ ID NO: 3019 - RNA, 27 nt, Artificial Sequence
  Synthetic Oligonucleotide
ccuggauggaaagaaacuaauuuucca

SEQ ID NO: 3020 - RNA, 27 nt, Artificial Sequence
  Synthetic Oligonucleotide
uggauggaaagaaacuaauuuucagac

SEQ ID NO: 3021 - RNA, 27 nt, Artificial Sequence
  Synthetic Oligonucleotide
gauggaaagaaacuaauuuucagguac

SEQ ID NO: 3022 - RNA, 27 nt, Artificial Sequence
  Synthetic Oligonucleotide
uggaaagaaacuaauuuucaggugaca

SEQ ID NO: 3023 - RNA, 27 nt, Artificial Sequence
  Synthetic Oligonucleotide
gaaagaaacuaauuuucaggugaugac

SEQ ID NO: 3024 - RNA, 27 nt, Artificial Sequence
  Synthetic Oligonucleotide
aagaaacuaauuuucaggugaugcacc

SEQ ID NO: 3025 - RNA, 27 nt, Artificial Sequence
  Synthetic Oligonucleotide
gaaacuaauuuucaggugaugcaaaca

SEQ ID NO: 3026 - RNA, 27 nt, Artificial Sequence
  Synthetic Oligonucleotide
aacuaauuuucaggugaugcaaaugcc

SEQ ID NO: 3027 - RNA, 27 nt, Artificial Sequence
  Synthetic Oligonucleotide
aguugcuuugauugcccagaagggacc

SEQ ID NO: 3028 - RNA, 27 nt, Artificial Sequence
  Synthetic Oligonucleotide
uugcuuugauugcccagaagggaaacc

SEQ ID NO: 3029 - RNA, 27 nt, Artificial Sequence
  Synthetic Oligonucleotide
gcuuugauugcccagaagggaaauucc

SEQ ID NO: 3030 - RNA, 27 nt, Artificial Sequence
  Synthetic Oligonucleotide
uuugauugcccagaagggaaauuuuca

SEQ ID NO: 3031 - RNA, 27 nt, Artificial Sequence
  Synthetic Oligonucleotide
ugauugcccagaagggaaauuuuucac

SEQ ID NO: 3032 - RNA, 27 nt, Artificial Sequence
  Synthetic Oligonucleotide
auugcccagaagggaaauuuuuccacc

SEQ ID NO: 3033 - RNA, 27 nt, Artificial Sequence
  Synthetic Oligonucleotide
ugcccagaagggaaauuuuuccaaaca

SEQ ID NO: 3034 - RNA, 27 nt, Artificial Sequence
  Synthetic Oligonucleotide
uggacaagauuggagaugugaaaugca

SEQ ID NO: 3035 - RNA, 27 nt, Artificial Sequence
  Synthetic Oligonucleotide
gacaagauuggagaugugaaaugugaa

SEQ ID NO: 3036 - RNA, 27 nt, Artificial Sequence
  Synthetic Oligonucleotide
caagauuggagaugugaaaugugggcc

SEQ ID NO: 3037 - RNA, 27 nt, Artificial Sequence
  Synthetic Oligonucleotide
agauuggagaugugaaaugugggaaac

SEQ ID NO: 3038 - RNA, 27 nt, Artificial Sequence
  Synthetic Oligonucleotide
auuggagaugugaaaugugggaacacc

SEQ ID NO: 3039 - RNA, 27 nt, Artificial Sequence
  Synthetic Oligonucleotide
uggagaugugaaaugugggaacaauaa

SEQ ID NO: 3040 - RNA, 27 nt, Artificial Sequence
  Synthetic Oligonucleotide
gagaugugaaaugugggaacaaugccc

SEQ ID NO: 3041 - RNA, 27 nt, Artificial Sequence
  Synthetic Oligonucleotide
gaugugaaaugugggaacaaugcaacc

SEQ ID NO: 3042 - RNA, 27 nt, Artificial Sequence
  Synthetic Oligonucleotide
ugugaaaugugggaacaaugcaaaaac

SEQ ID NO: 3043 - RNA, 27 nt, Artificial Sequence
  Synthetic Oligonucleotide
ugaaaugugggaacaaugcaaaagaca

SEQ ID NO: 3044 - RNA, 27 nt, Artificial Sequence
  Synthetic Oligonucleotide
aaaugugggaacaaugcaaaagaagac

SEQ ID NO: 3045 - RNA, 27 nt, Artificial Sequence
  Synthetic Oligonucleotide
augugggaacaaugcaaaagaagcucc

SEQ ID NO: 3046 - RNA, 27 nt, Artificial Sequence
  Synthetic Oligonucleotide
gugggaacaaugcaaaagaagcuauac

SEQ ID NO: 3047 - RNA, 27 nt, Artificial Sequence
  Synthetic Oligonucleotide
ggguugaaugucaaagcuuucauuaaa

SEQ ID NO: 3048 - RNA, 27 nt, Artificial Sequence
  Synthetic Oligonucleotide
guugaaugucaaagcuuucauuagccc

SEQ ID NO: 3049 - RNA, 27 nt, Artificial Sequence
  Synthetic Oligonucleotide
ugaaugucaaagcuuucauuagcaaca

SEQ ID NO: 3050 - RNA, 27 nt, Artificial Sequence
  Synthetic Oligonucleotide
aaugucaaagcuuucauuagcaaugca

SEQ ID NO: 3051 - RNA, 27 nt, Artificial Sequence
  Synthetic Oligonucleotide
ugucaaagcuuucauuagcaaugugcc

SEQ ID NO: 3052 - RNA, 27 nt, Artificial Sequence
  Synthetic Oligonucleotide
aacccugcuuggcgugauguaucugcc

SEQ ID NO: 3053 - RNA, 27 nt, Artificial Sequence
  Synthetic Oligonucleotide
cccugcuuggcgugauguaucuguaca

SEQ ID NO: 3054 - RNA, 27 nt, Artificial Sequence
  Synthetic Oligonucleotide
guucuuugaggaugagaagccugccac

SEQ ID NO: 3055 - RNA, 27 nt, Artificial Sequence
  Synthetic Oligonucleotide
ucuuugaggaugagaagccugcccuaa

SEQ ID NO: 3056 - RNA, 27 nt, Artificial Sequence
  Synthetic Oligonucleotide
uuugaggaugagaagccugcccucccc

SEQ ID NO: 3057 - RNA, 27 nt, Artificial Sequence
  Synthetic Oligonucleotide
ugaggaugagaagccugcccuccuaca

SEQ ID NO: 3058 - RNA, 27 nt, Artificial Sequence
  Synthetic Oligonucleotide
aggaugagaagccugcccuccuaucaa

SEQ ID NO: 3059 - RNA, 27 nt, Artificial Sequence
  Synthetic Oligonucleotide
gaugagaagccugcccuccuaucccca

SEQ ID NO: 3060 - RNA, 27 nt, Artificial Sequence
  Synthetic Oligonucleotide
ugagaagccugcccuccuaucccagcc

SEQ ID NO: 3061 - RNA, 27 nt, Artificial Sequence
  Synthetic Oligonucleotide
agaagccugcccuccuaucccagauca

SEQ ID NO: 3062 - RNA, 27 nt, Artificial Sequence
  Synthetic Oligonucleotide
aagccugcccuccuaucccagauagcc

SEQ ID NO: 3063 - RNA, 27 nt, Artificial Sequence
  Synthetic Oligonucleotide
gccugcccuccuaucccagauagauaa

SEQ ID NO: 3064 - RNA, 27 nt, Artificial Sequence
  Synthetic Oligonucleotide
cugcccuccuaucccagauagaugcca

SEQ ID NO: 3065 - RNA, 27 nt, Artificial Sequence
  Synthetic Oligonucleotide
gcccuccuaucccagauagaugcagcc

SEQ ID NO: 3066 - RNA, 27 nt, Artificial Sequence
  Synthetic Oligonucleotide
ccuccuaucccagauagaugcagaacc

SEQ ID NO: 3067 - RNA, 27 nt, Artificial Sequence
  Synthetic Oligonucleotide
uccuaucccagauagaugcagaauuca

SEQ ID NO: 3068 - RNA, 27 nt, Artificial Sequence
  Synthetic Oligonucleotide
cuaucccagauagaugcagaauuugca

SEQ ID NO: 3069 - RNA, 27 nt, Artificial Sequence
  Synthetic Oligonucleotide
aucccagauagaugcagaauuugagcc

SEQ ID NO: 3070 - RNA, 27 nt, Artificial Sequence
  Synthetic Oligonucleotide
agaagaugcagggacaaaguccaccca

SEQ ID NO: 3071 - RNA, 27 nt, Artificial Sequence
  Synthetic Oligonucleotide
gguacagaugaaggagaagauggagcc

SEQ ID NO: 3072 - RNA, 27 nt, Artificial Sequence
  Synthetic Oligonucleotide
uacagaugaaggagaagauggagauac

SEQ ID NO: 3073 - RNA, 27 nt, Artificial Sequence
  Synthetic Oligonucleotide
cagaugaaggagaagauggagaugaca

SEQ ID NO: 3074 - RNA, 27 nt, Artificial Sequence
  Synthetic Oligonucleotide
ucguugaucuuuugccgaggacggaac

SEQ ID NO: 3075 - RNA, 27 nt, Artificial Sequence
  Synthetic Oligonucleotide
uaggaaagaaggccuagaugaagugaa

SEQ ID NO: 3076 - RNA, 27 nt, Artificial Sequence
  Synthetic Oligonucleotide
ggaaagaaggccuagaugaaguggcca

SEQ ID NO: 3077 - RNA, 27 nt, Artificial Sequence
  Synthetic Oligonucleotide
aaagaaggccuagaugaaguggcagac

SEQ ID NO: 3078 - RNA, 27 nt, Artificial Sequence
  Synthetic Oligonucleotide
agaaggccuagaugaaguggcaggucc

SEQ ID NO: 3079 - RNA, 27 nt, Artificial Sequence
  Synthetic Oligonucleotide
aaggccuagaugaaguggcagguaucc

SEQ ID NO: 3080 - RNA, 27 nt, Artificial Sequence
  Synthetic Oligonucleotide
ggccuagaugaaguggcagguauuacc

SEQ ID NO: 3081 - RNA, 27 nt, Artificial Sequence
  Synthetic Oligonucleotide
ccuagaugaaguggcagguauuauucc

SEQ ID NO: 3082 - RNA, 27 nt, Artificial Sequence
  Synthetic Oligonucleotide
uagaugaaguggcagguauuauuaaca

SEQ ID NO: 3083 - RNA, 27 nt, Artificial Sequence
  Synthetic Oligonucleotide
cgaauauaggugaacuuccaacugcac

SEQ ID NO: 3084 - RNA, 27 nt, Artificial Sequence
  Synthetic Oligonucleotide
aauauaggugaacuuccaacugccuca

SEQ ID NO: 3085 - RNA, 27 nt, Artificial Sequence
  Synthetic Oligonucleotide
uauaggugaacuuccaacugccuugcc

SEQ ID NO: 3086 - RNA, 27 nt, Artificial Sequence
  Synthetic Oligonucleotide
uaggugaacuuccaacugccuugaaaa

SEQ ID NO: 3087 - RNA, 27 nt, Artificial Sequence
  Synthetic Oligonucleotide
ggugaacuuccaacugccuugaaggac

SEQ ID NO: 3088 - RNA, 27 nt, Artificial Sequence
  Synthetic Oligonucleotide
ugaacuuccaacugccuugaaggguaa

SEQ ID NO: 3089 - RNA, 27 nt, Artificial Sequence
  Synthetic Oligonucleotide
aacuuccaacugccuugaagggucgca

SEQ ID NO: 3090 - RNA, 27 nt, Artificial Sequence
  Synthetic Oligonucleotide
cuuccaacugccuugaagggucgacca

SEQ ID NO: 3091 - RNA, 27 nt, Artificial Sequence
  Synthetic Oligonucleotide
uccaacugccuugaagggucgacuccc

SEQ ID NO: 3092 - RNA, 27 nt, Artificial Sequence
  Synthetic Oligonucleotide
caacugccuugaagggucgacucaaca

SEQ ID NO: 3093 - RNA, 27 nt, Artificial Sequence
  Synthetic Oligonucleotide
aacaacuggcaguagccaugggccccc

SEQ ID NO: 3094 - RNA, 27 nt, Artificial Sequence
  Synthetic Oligonucleotide
acagcaagaacaauguucgagcugcca

SEQ ID NO: 3095 - RNA, 27 nt, Artificial Sequence
  Synthetic Oligonucleotide
agcaagaacaauguucgagcugcugaa

SEQ ID NO: 3096 - RNA, 27 nt, Artificial Sequence
  Synthetic Oligonucleotide
caagaacaauguucgagcugcugccac

SEQ ID NO: 3097 - RNA, 27 nt, Artificial Sequence
  Synthetic Oligonucleotide
agaacaauguucgagcugcugcccuca

SEQ ID NO: 3098 - RNA, 27 nt, Artificial Sequence
  Synthetic Oligonucleotide
aacaauguucgagcugcugcccuagaa

SEQ ID NO: 3099 - RNA, 27 nt, Artificial Sequence
  Synthetic Oligonucleotide
caauguucgagcugcugcccuagcgca

SEQ ID NO: 3100 - RNA, 27 nt, Artificial Sequence
  Synthetic Oligonucleotide
auguucgagcugcugcccuagcgacca

SEQ ID NO: 3101 - RNA, 27 nt, Artificial Sequence
  Synthetic Oligonucleotide
cgacugugaaugcuugggcagaacaac

SEQ ID NO: 3102 - RNA, 27 nt, Artificial Sequence
  Synthetic Oligonucleotide
acugugaaugcuugggcagaacagaac

SEQ ID NO: 3103 - RNA, 27 nt, Artificial Sequence
  Synthetic Oligonucleotide
ugugaaugcuugggcagaacagacuaa

SEQ ID NO: 3104 - RNA, 27 nt, Artificial Sequence
  Synthetic Oligonucleotide
aggagaagaucuuucugaagagcuccc

SEQ ID NO: 3105 - RNA, 27 nt, Artificial Sequence
  Synthetic Oligonucleotide
gccuagaagaucgaaauggagauguaa

SEQ ID NO: 3106 - RNA, 27 nt, Artificial Sequence
  Synthetic Oligonucleotide
cuagaagaucgaaauggagaugugcac

SEQ ID NO: 3107 - RNA, 27 nt, Artificial Sequence
  Synthetic Oligonucleotide
agaagaucgaaauggagaugugcgacc

SEQ ID NO: 3108 - RNA, 27 nt, Artificial Sequence
  Synthetic Oligonucleotide
caugaugcauuuaggauaugaaaaacc

SEQ ID NO: 3109 - RNA, 27 nt, Artificial Sequence
  Synthetic Oligonucleotide
ugaugcauuuaggauaugaaaaaauaa

SEQ ID NO: 3110 - RNA, 27 nt, Artificial Sequence
  Synthetic Oligonucleotide
augcauuuaggauaugaaaaaauggaa

SEQ ID NO: 3111 - RNA, 27 nt, Artificial Sequence
  Synthetic Oligonucleotide
gcauuuaggauaugaaaaaauggcccc

SEQ ID NO: 3112 - RNA, 27 nt, Artificial Sequence
  Synthetic Oligonucleotide
auuuaggauaugaaaaaauggccaaaa

SEQ ID NO: 3113 - RNA, 27 nt, Artificial Sequence
  Synthetic Oligonucleotide
ccaaggcuacugggaaacuaaagcccc

SEQ ID NO: 3114 - RNA, 27 nt, Artificial Sequence
  Synthetic Oligonucleotide
aaggcuacugggaaacuaaagccaaac

SEQ ID NO: 3115 - RNA, 27 nt, Artificial Sequence
  Synthetic Oligonucleotide
ggcuacugggaaacuaaagccaacuca

SEQ ID NO: 3116 - RNA, 27 nt, Artificial Sequence
  Synthetic Oligonucleotide
cuacugggaaacuaaagccaacuuccc

SEQ ID NO: 3117 - RNA, 27 nt, Artificial Sequence
  Synthetic Oligonucleotide
acugggaaacuaaagccaacuucuacc

SEQ ID NO: 3118 - RNA, 27 nt, Artificial Sequence
  Synthetic Oligonucleotide
ugggaaacuaaagccaacuucuaaaac

SEQ ID NO: 3119 - RNA, 27 nt, Artificial Sequence
  Synthetic Oligonucleotide
ggaaacuaaagccaacuucuaaagaca

SEQ ID NO: 3120 - RNA, 27 nt, Artificial Sequence
  Synthetic Oligonucleotide
aaacuaaagccaacuucuaaagaucca

SEQ ID NO: 3121 - RNA, 27 nt, Artificial Sequence
  Synthetic Oligonucleotide
acuaaagccaacuucuaaagaucagac

SEQ ID NO: 3122 - RNA, 27 nt, Artificial Sequence
  Synthetic Oligonucleotide
uaaagccaacuucuaaagaucaggucc

SEQ ID NO: 3123 - RNA, 27 nt, Artificial Sequence
  Synthetic Oligonucleotide
ggccuauuuuuauuguuguuccaaaca

SEQ ID NO: 3124 - RNA, 27 nt, Artificial Sequence
  Synthetic Oligonucleotide
ccuauuuuuauuguuguuccaaaugac

SEQ ID NO: 3125 - RNA, 27 nt, Artificial Sequence
  Synthetic Oligonucleotide
uauuuuuauuguuguuccaaauggacc

SEQ ID NO: 3126 - RNA, 27 nt, Artificial Sequence
  Synthetic Oligonucleotide
uuuuuauuguuguuccaaauggaaaca

SEQ ID NO: 3127 - RNA, 27 nt, Artificial Sequence
  Synthetic Oligonucleotide
uuuauuguuguuccaaauggaaaagca

SEQ ID NO: 3128 - RNA, 27 nt, Artificial Sequence
  Synthetic Oligonucleotide
uauuguuguuccaaauggaaaagagac

SEQ ID NO: 3129 - RNA, 27 nt, Artificial Sequence
  Synthetic Oligonucleotide
gaaggugcuaaaguggaauuuuacuca

SEQ ID NO: 3130 - RNA, 27 nt, Artificial Sequence
  Synthetic Oligonucleotide
aggugcuaaaguggaauuuuacuacaa

SEQ ID NO: 3131 - RNA, 27 nt, Artificial Sequence
  Synthetic Oligonucleotide
auaucaucuuacugagaaugaagcaca

SEQ ID NO: 3132 - RNA, 27 nt, Artificial Sequence
  Synthetic Oligonucleotide
aucaucuuacugagaaugaagcauccc

SEQ ID NO: 3133 - RNA, 27 nt, Artificial Sequence
  Synthetic Oligonucleotide
caucuuacugagaaugaagcaucuuaa

SEQ ID NO: 3134 - RNA, 27 nt, Artificial Sequence
  Synthetic Oligonucleotide
ucuuacugagaaugaagcaucuucccc

SEQ ID NO: 3135 - RNA, 27 nt, Artificial Sequence
  Synthetic Oligonucleotide
gucaagguuggagaaccaaaggaugca

SEQ ID NO: 3136 - RNA, 27 nt, Artificial Sequence
  Synthetic Oligonucleotide
caagguuggagaaccaaaggauguccc

SEQ ID NO: 3137 - RNA, 27 nt, Artificial Sequence
  Synthetic Oligonucleotide
agguuggagaaccaaaggaugucauca

SEQ ID NO: 3138 - RNA, 27 nt, Artificial Sequence
  Synthetic Oligonucleotide
guuggagaaccaaaggaugucauucac

SEQ ID NO: 3139 - RNA, 27 nt, Artificial Sequence
  Synthetic Oligonucleotide
uggagaaccaaaggaugucauucgucc

SEQ ID NO: 3140 - RNA, 27 nt, Artificial Sequence
  Synthetic Oligonucleotide
gagaaccaaaggaugucauucguaaca

SEQ ID NO: 3141 - RNA, 27 nt, Artificial Sequence
  Synthetic Oligonucleotide
gaaccaaaggaugucauucguaaagcc

SEQ ID NO: 3142 - RNA, 27 nt, Artificial Sequence
  Synthetic Oligonucleotide
accaaaggaugucauucguaaagauac

SEQ ID NO: 3143 - RNA, 27 nt, Artificial Sequence
  Synthetic Oligonucleotide
caaaggaugucauucguaaagauguca

SEQ ID NO: 3144 - RNA, 27 nt, Artificial Sequence
  Synthetic Oligonucleotide
aaggaugucauucguaaagauguucac

SEQ ID NO: 3145 - RNA, 27 nt, Artificial Sequence
  Synthetic Oligonucleotide
ggaugucauucguaaagauguucguaa

SEQ ID NO: 3146 - RNA, 27 nt, Artificial Sequence
  Synthetic Oligonucleotide
cauccugaaccggaugugccuuguccc

SEQ ID NO: 3147 - RNA, 27 nt, Artificial Sequence
  Synthetic Oligonucleotide
uccugaaccggaugugccuugucuaaa

SEQ ID NO: 3148 - RNA, 27 nt, Artificial Sequence
  Synthetic Oligonucleotide
cugaaccggaugugccuugucuaccac

SEQ ID NO: 3149 - RNA, 27 nt, Artificial Sequence
  Synthetic Oligonucleotide
gaaccggaugugccuugucuacccaaa

SEQ ID NO: 3150 - RNA, 27 nt, Artificial Sequence
  Synthetic Oligonucleotide
accggaugugccuugucuacccagccc

SEQ ID NO: 3151 - RNA, 27 nt, Artificial Sequence
  Synthetic Oligonucleotide
cggaugugccuugucuacccagcuaaa

SEQ ID NO: 3152 - RNA, 27 nt, Artificial Sequence
  Synthetic Oligonucleotide
gaugugccuugucuacccagcuagccc

SEQ ID NO: 3153 - RNA, 27 nt, Artificial Sequence
  Synthetic Oligonucleotide
auccaaaaacucuaagcagagagcaac

SEQ ID NO: 3154 - RNA, 27 nt, Artificial Sequence
  Synthetic Oligonucleotide
ccaaaaacucuaagcagagagcagaac

SEQ ID NO: 3155 - RNA, 27 nt, Artificial Sequence
  Synthetic Oligonucleotide
aaaaacucuaagcagagagcagaguaa

SEQ ID NO: 3156 - RNA, 27 nt, Artificial Sequence
  Synthetic Oligonucleotide
aaacucuaagcagagagcagagugcac

SEQ ID NO: 3157 - RNA, 27 nt, Artificial Sequence
  Synthetic Oligonucleotide
acucuaagcagagagcagagugccuaa

SEQ ID NO: 3158 - RNA, 27 nt, Artificial Sequence
  Synthetic Oligonucleotide
ucuaagcagagagcagagugccuggcc

SEQ ID NO: 3159 - RNA, 27 nt, Artificial Sequence
  Synthetic Oligonucleotide
uaagcagagagcagagugccuggaaac

SEQ ID NO: 3160 - RNA, 27 nt, Artificial Sequence
  Synthetic Oligonucleotide
agcagagagcagagugccuggaagaaa

SEQ ID NO: 3161 - RNA, 27 nt, Artificial Sequence
  Synthetic Oligonucleotide
cagagagcagagugccuggaagagcca

SEQ ID NO: 3162 - RNA, 27 nt, Artificial Sequence
  Synthetic Oligonucleotide
gagagcagagugccuggaagagcugaa

SEQ ID NO: 3163 - RNA, 27 nt, Artificial Sequence
  Synthetic Oligonucleotide
gagcagagugccuggaagagcugggcc

SEQ ID NO: 3164 - RNA, 27 nt, Artificial Sequence
  Synthetic Oligonucleotide
cccaggaaaagccuuaaaggaaauaaa

SEQ ID NO: 3165 - RNA, 27 nt, Artificial Sequence
  Synthetic Oligonucleotide
ggaucagguguucaaacugauuggacc

SEQ ID NO: 3166 - RNA, 27 nt, Artificial Sequence
  Synthetic Oligonucleotide
aucagguguucaaacugauuggaaaca

SEQ ID NO: 3167 - RNA, 27 nt, Artificial Sequence
  Synthetic Oligonucleotide
cagguguucaaacugauuggaaauccc

SEQ ID NO: 3168 - RNA, 27 nt, Artificial Sequence
  Synthetic Oligonucleotide
gguguucaaacugauuggaaaucuuca

SEQ ID NO: 3169 - RNA, 27 nt, Artificial Sequence
  Synthetic Oligonucleotide
uguucaaacugauuggaaaucuuucca

SEQ ID NO: 3170 - RNA, 27 nt, Artificial Sequence
  Synthetic Oligonucleotide
uucaaacugauuggaaaucuuucugcc

SEQ ID NO: 3171 - RNA, 27 nt, Artificial Sequence
  Synthetic Oligonucleotide
caaacugauuggaaaucuuucugaacc

SEQ ID NO: 3172 - RNA, 27 nt, Artificial Sequence
  Synthetic Oligonucleotide
aacugauuggaaaucuuucugaaaaaa

SEQ ID NO: 3173 - RNA, 27 nt, Artificial Sequence
  Synthetic Oligonucleotide
uuaagcggucagcaaagagacccucca

SEQ ID NO: 3174 - RNA, 27 nt, Artificial Sequence
  Synthetic Oligonucleotide
aagcggucagcaaagagacccucugac

SEQ ID NO: 3175 - RNA, 27 nt, Artificial Sequence
  Synthetic Oligonucleotide
gcggucagcaaagagacccucugcuaa

SEQ ID NO: 3176 - RNA, 27 nt, Artificial Sequence
  Synthetic Oligonucleotide
ggucagcaaagagacccucugcugcca

SEQ ID NO: 3177 - RNA, 27 nt, Artificial Sequence
  Synthetic Oligonucleotide
ucagcaaagagacccucugcugcacac

SEQ ID NO: 3178 - RNA, 27 nt, Artificial Sequence
  Synthetic Oligonucleotide
agcaaagagacccucugcugcaccacc

SEQ ID NO: 3179 - RNA, 27 nt, Artificial Sequence
  Synthetic Oligonucleotide
caaagagacccucugcugcaccaaucc

SEQ ID NO: 3180 - RNA, 27 nt, Artificial Sequence
  Synthetic Oligonucleotide
guuacgcaagggaccagcugaggaccc

SEQ ID NO: 3181 - RNA, 27 nt, Artificial Sequence
  Synthetic Oligonucleotide
uacgcaagggaccagcugaggacauac

SEQ ID NO: 3182 - RNA, 27 nt, Artificial Sequence
  Synthetic Oligonucleotide
uccgccgagaauuccagcuggaucuca

SEQ ID NO: 3183 - RNA, 27 nt, Artificial Sequence
  Synthetic Oligonucleotide
cgccgagaauuccagcuggaucuagcc

SEQ ID NO: 3184 - RNA, 27 nt, Artificial Sequence
  Synthetic Oligonucleotide
caagauccgggcuguuucuccacaccc

SEQ ID NO: 3185 - RNA, 27 nt, Artificial Sequence
  Synthetic Oligonucleotide
agauccgggcuguuucuccacacuuaa

SEQ ID NO: 3186 - RNA, 27 nt, Artificial Sequence
  Synthetic Oligonucleotide
ucgaugacaugcacaguaauacagccc

SEQ ID NO: 3187 - RNA, 27 nt, Artificial Sequence
  Synthetic Oligonucleotide
gaugacaugcacaguaauacagcauaa

SEQ ID NO: 3188 - RNA, 27 nt, Artificial Sequence
  Synthetic Oligonucleotide
ugacaugcacaguaauacagcauccca

SEQ ID NO: 3189 - RNA, 27 nt, Artificial Sequence
  Synthetic Oligonucleotide
acaugcacaguaauacagcauccaccc

SEQ ID NO: 3190 - RNA, 27 nt, Artificial Sequence
  Synthetic Oligonucleotide
augcacaguaauacagcauccacaaca

SEQ ID NO: 3191 - RNA, 27 nt, Artificial Sequence
  Synthetic Oligonucleotide
gcacaguaauacagcauccacaauccc

SEQ ID NO: 3192 - RNA, 27 nt, Artificial Sequence
  Synthetic Oligonucleotide
acaguaauacagcauccacaaucaacc

SEQ ID NO: 3193 - RNA, 27 nt, Artificial Sequence
  Synthetic Oligonucleotide
aguaauacagcauccacaaucaauuca

SEQ ID NO: 3194 - RNA, 27 nt, Artificial Sequence
  Synthetic Oligonucleotide
uaauacagcauccacaaucaauuuccc

SEQ ID NO: 3195 - RNA, 27 nt, Artificial Sequence
  Synthetic Oligonucleotide
auacagcauccacaaucaauuucaucc

SEQ ID NO: 3196 - RNA, 27 nt, Artificial Sequence
  Synthetic Oligonucleotide
acagcauccacaaucaauuucauuaca

SEQ ID NO: 3197 - RNA, 27 nt, Artificial Sequence
  Synthetic Oligonucleotide
agcauccacaaucaauuucauuaucca

SEQ ID NO: 3198 - RNA, 27 nt, Artificial Sequence
  Synthetic Oligonucleotide
cauccacaaucaauuucauuaucucaa

SEQ ID NO: 3199 - RNA, 27 nt, Artificial Sequence
  Synthetic Oligonucleotide
uccacaaucaauuucauuaucuccccc

SEQ ID NO: 3200 - RNA, 27 nt, Artificial Sequence
  Synthetic Oligonucleotide
cacaaucaauuucauuaucucccaaac

SEQ ID NO: 3201 - RNA, 27 nt, Artificial Sequence
  Synthetic Oligonucleotide
caaucaauuucauuaucucccaaguca

SEQ ID NO: 3202 - RNA, 27 nt, Artificial Sequence
  Synthetic Oligonucleotide
aucaauuucauuaucucccaaguagaa

SEQ ID NO: 3203 - RNA, 27 nt, Artificial Sequence
  Synthetic Oligonucleotide
caauuucauuaucucccaaguagccca

SEQ ID NO: 3204 - RNA, 27 nt, Artificial Sequence
  Synthetic Oligonucleotide
auuucauuaucucccaaguagccagca

SEQ ID NO: 3205 - RNA, 27 nt, Artificial Sequence
  Synthetic Oligonucleotide
uucauuaucucccaaguagccagugac

SEQ ID NO: 3206 - RNA, 27 nt, Artificial Sequence
  Synthetic Oligonucleotide
cauuaucucccaaguagccagugguac

SEQ ID NO: 3207 - RNA, 27 nt, Artificial Sequence
  Synthetic Oligonucleotide
uuaucucccaaguagccaguggugaac

SEQ ID NO: 3208 - RNA, 27 nt, Artificial Sequence
  Synthetic Oligonucleotide
aucucccaaguagccaguggugacaca

SEQ ID NO: 3209 - RNA, 27 nt, Artificial Sequence
  Synthetic Oligonucleotide
cucccaaguagccaguggugacauccc

SEQ ID NO: 3210 - RNA, 27 nt, Artificial Sequence
  Synthetic Oligonucleotide
cccaaguagccaguggugacaucaaac

SEQ ID NO: 3211 - RNA, 27 nt, Artificial Sequence
  Synthetic Oligonucleotide
uugcccgggaggccuccacuggaguca

SEQ ID NO: 3212 - RNA, 27 nt, Artificial Sequence
  Synthetic Oligonucleotide
gcccgggaggccuccacuggaguaccc

SEQ ID NO: 3213 - RNA, 27 nt, Artificial Sequence
  Synthetic Oligonucleotide
ccgggaggccuccacuggaguacuacc

SEQ ID NO: 3214 - RNA, 27 nt, Artificial Sequence
  Synthetic Oligonucleotide
gggaggccuccacuggaguacuaaaca

SEQ ID NO: 3215 - RNA, 27 nt, Artificial Sequence
  Synthetic Oligonucleotide
ucaucaccuuaaugcuggauucucgac

SEQ ID NO: 3216 - RNA, 27 nt, Artificial Sequence
  Synthetic Oligonucleotide
aucaccuuaaugcuggauucucggacc

SEQ ID NO: 3217 - RNA, 27 nt, Artificial Sequence
  Synthetic Oligonucleotide
caccuuaaugcuggauucucggauuac

SEQ ID NO: 3218 - RNA, 27 nt, Artificial Sequence
  Synthetic Oligonucleotide
ccuuaaugcuggauucucggauugaca

SEQ ID NO: 3219 - RNA, 27 nt, Artificial Sequence
  Synthetic Oligonucleotide
uuaaugcuggauucucggauugaagcc

SEQ ID NO: 3220 - RNA, 27 nt, Artificial Sequence
  Synthetic Oligonucleotide
aaugcuggauucucggauugaagauac

SEQ ID NO: 3221 - RNA, 27 nt, Artificial Sequence
  Synthetic Oligonucleotide
ugcuggauucucggauugaagaucuca

SEQ ID NO: 3222 - RNA, 27 nt, Artificial Sequence
  Synthetic Oligonucleotide
cuggauucucggauugaagaucuugca

SEQ ID NO: 3223 - RNA, 27 nt, Artificial Sequence
  Synthetic Oligonucleotide
ggauucucggauugaagaucuugagac

SEQ ID NO: 3224 - RNA, 27 nt, Artificial Sequence
  Synthetic Oligonucleotide
cucugugaaccucuugguggugaagac

SEQ ID NO: 3225 - RNA, 27 nt, Artificial Sequence
  Synthetic Oligonucleotide
cugugaaccucuugguggugaagguca

SEQ ID NO: 3226 - RNA, 27 nt, Artificial Sequence
  Synthetic Oligonucleotide
gugaaccucuugguggugaagguucca

SEQ ID NO: 3227 - RNA, 27 nt, Artificial Sequence
  Synthetic Oligonucleotide
gaaccucuugguggugaagguucugac

SEQ ID NO: 3228 - RNA, 27 nt, Artificial Sequence
  Synthetic Oligonucleotide
aagacagccugcuagcaacagccagcc

SEQ ID NO: 3229 - RNA, 27 nt, Artificial Sequence
  Synthetic Oligonucleotide
ccaguucucccaaauucucagagcuca

SEQ ID NO: 3230 - RNA, 27 nt, Artificial Sequence
  Synthetic Oligonucleotide
aguucucccaaauucucagagcuugcc

SEQ ID NO: 3231 - RNA, 27 nt, Artificial Sequence
  Synthetic Oligonucleotide
uucucccaaauucucagagcuuguucc

SEQ ID NO: 3232 - RNA, 27 nt, Artificial Sequence
  Synthetic Oligonucleotide
cucccaaauucucagagcuuguuauac

SEQ ID NO: 3233 - RNA, 27 nt, Artificial Sequence
  Synthetic Oligonucleotide
cccaaauucucagagcuuguuaugaca

SEQ ID NO: 3234 - RNA, 27 nt, Artificial Sequence
  Synthetic Oligonucleotide
caaauucucagagcuuguuaugaagca

SEQ ID NO: 3235 - RNA, 27 nt, Artificial Sequence
  Synthetic Oligonucleotide
aauucucagagcuuguuaugaagugca

SEQ ID NO: 3236 - RNA, 27 nt, Artificial Sequence
  Synthetic Oligonucleotide
uucucagagcuuguuaugaagugucca

SEQ ID NO: 3237 - RNA, 27 nt, Artificial Sequence
  Synthetic Oligonucleotide
cucagagcuuguuaugaagugucucca

SEQ ID NO: 3238 - RNA, 27 nt, Artificial Sequence
  Synthetic Oligonucleotide
cagagcuuguuaugaagugucucugac

SEQ ID NO: 3239 - RNA, 27 nt, Artificial Sequence
  Synthetic Oligonucleotide
auagcauuaaccuagacagaauucuca

SEQ ID NO: 3240 - RNA, 27 nt, Artificial Sequence
  Synthetic Oligonucleotide
agcauuaaccuagacagaauucuucca

SEQ ID NO: 3241 - RNA, 27 nt, Artificial Sequence
  Synthetic Oligonucleotide
cauuaaccuagacagaauucuucugac

SEQ ID NO: 3242 - RNA, 27 nt, Artificial Sequence
  Synthetic Oligonucleotide
uuaaccuagacagaauucuucuggacc

SEQ ID NO: 3243 - RNA, 27 nt, Artificial Sequence
  Synthetic Oligonucleotide
aaccuagacagaauucuucuggauaca

SEQ ID NO: 3244 - RNA, 27 nt, Artificial Sequence
  Synthetic Oligonucleotide
ccuagacagaauucuucuggauaucac

SEQ ID NO: 3245 - RNA, 27 nt, Artificial Sequence
  Synthetic Oligonucleotide
uauccacauuuucaugaaggucuucaa

SEQ ID NO: 3246 - RNA, 27 nt, Artificial Sequence
  Synthetic Oligonucleotide
cugaagcaaugcaaaagugaauuucaa

SEQ ID NO: 3247 - RNA, 27 nt, Artificial Sequence
  Synthetic Oligonucleotide
gaagcaaugcaaaagugaauuuccccc

SEQ ID NO: 3248 - RNA, 27 nt, Artificial Sequence
  Synthetic Oligonucleotide
agcaaugcaaaagugaauuucccaucc

SEQ ID NO: 3249 - RNA, 27 nt, Artificial Sequence
  Synthetic Oligonucleotide
acaguauggaccagacugggagcaaac

SEQ ID NO: 3250 - RNA, 27 nt, Artificial Sequence
  Synthetic Oligonucleotide
aguauggaccagacugggagcaaguac

SEQ ID NO: 3251 - RNA, 27 nt, Artificial Sequence
  Synthetic Oligonucleotide
uauggaccagacugggagcaagucuac

SEQ ID NO: 3252 - RNA, 27 nt, Artificial Sequence
  Synthetic Oligonucleotide
uggaccagacugggagcaagucugacc

SEQ ID NO: 3253 - RNA, 27 nt, Artificial Sequence
  Synthetic Oligonucleotide
gaccagacugggagcaagucugauaca

SEQ ID NO: 3254 - RNA, 27 nt, Artificial Sequence
  Synthetic Oligonucleotide
ccagacugggagcaagucugauaagac

SEQ ID NO: 3255 - RNA, 27 nt, Artificial Sequence
  Synthetic Oligonucleotide
agacugggagcaagucugauaaggacc

SEQ ID NO: 3256 - RNA, 27 nt, Artificial Sequence
  Synthetic Oligonucleotide
acugggagcaagucugauaaggaaaac

SEQ ID NO: 3257 - RNA, 27 nt, Artificial Sequence
  Synthetic Oligonucleotide
ugggagcaagucugauaaggaaacaac

SEQ ID NO: 3258 - RNA, 27 nt, Artificial Sequence
  Synthetic Oligonucleotide
ggagcaagucugauaaggaaacagacc

SEQ ID NO: 3259 - RNA, 27 nt, Artificial Sequence
  Synthetic Oligonucleotide
agcaagucugauaaggaaacagaaaca

SEQ ID NO: 3260 - RNA, 27 nt, Artificial Sequence
  Synthetic Oligonucleotide
caagucugauaaggaaacagaaaagaa

SEQ ID NO: 3261 - RNA, 27 nt, Artificial Sequence
  Synthetic Oligonucleotide
agucugauaaggaaacagaaaagggca

SEQ ID NO: 3262 - RNA, 27 nt, Artificial Sequence
  Synthetic Oligonucleotide
ucugauaaggaaacagaaaagggagac

SEQ ID NO: 3263 - RNA, 27 nt, Artificial Sequence
  Synthetic Oligonucleotide
ugauaaggaaacagaaaagggagcaca

SEQ ID NO: 3264 - RNA, 27 nt, Artificial Sequence
  Synthetic Oligonucleotide
auaaggaaacagaaaagggagcaucca

SEQ ID NO: 3265 - RNA, 27 nt, Artificial Sequence
  Synthetic Oligonucleotide
caucucgaauagaugaaaaaucauccc

SEQ ID NO: 3266 - RNA, 27 nt, Artificial Sequence
  Synthetic Oligonucleotide
ucucgaauagaugaaaaaucaucaaca

SEQ ID NO: 3267 - RNA, 27 nt, Artificial Sequence
  Synthetic Oligonucleotide
ucgaauagaugaaaaaucaucaaagaa

SEQ ID NO: 3268 - RNA, 27 nt, Artificial Sequence
  Synthetic Oligonucleotide
gaauagaugaaaaaucaucaaaggcac

SEQ ID NO: 3269 - RNA, 27 nt, Artificial Sequence
  Synthetic Oligonucleotide
auagaugaaaaaucaucaaaggccacc

SEQ ID NO: 3270 - RNA, 27 nt, Artificial Sequence
  Synthetic Oligonucleotide
agaugaaaaaucaucaaaggccaaaac

SEQ ID NO: 3271 - RNA, 27 nt, Artificial Sequence
  Synthetic Oligonucleotide
augaaaaaucaucaaaggccaaaguac

SEQ ID NO: 3272 - RNA, 27 nt, Artificial Sequence
  Synthetic Oligonucleotide
gaaaaaucaucaaaggccaaagugacc

SEQ ID NO: 3273 - RNA, 27 nt, Artificial Sequence
  Synthetic Oligonucleotide
aaaaucaucaaaggccaaagugaauac

SEQ ID NO: 3274 - RNA, 27 nt, Artificial Sequence
  Synthetic Oligonucleotide
gaaugauuucuuagcugagauuuuucc

SEQ ID NO: 3275 - RNA, 27 nt, Artificial Sequence
  Synthetic Oligonucleotide
augauuucuuagcugagauuuuuaaac

SEQ ID NO: 3276 - RNA, 27 nt, Artificial Sequence
  Synthetic Oligonucleotide
gauuucuuagcugagauuuuuaagaca

SEQ ID NO: 3277 - RNA, 27 nt, Artificial Sequence
  Synthetic Oligonucleotide
uuucuuagcugagauuuuuaagaagcc

SEQ ID NO: 3278 - RNA, 27 nt, Artificial Sequence
  Synthetic Oligonucleotide
ucuuagcugagauuuuuaagaagauca

SEQ ID NO: 3279 - RNA, 27 nt, Artificial Sequence
  Synthetic Oligonucleotide
uuagcugagauuuuuaagaagauugaa

SEQ ID NO: 3280 - RNA, 27 nt, Artificial Sequence
  Synthetic Oligonucleotide
agcugagauuuuuaagaagauuggcca

SEQ ID NO: 3281 - RNA, 27 nt, Artificial Sequence
  Synthetic Oligonucleotide
cugagauuuuuaagaagauuggcuccc

SEQ ID NO: 3282 - RNA, 27 nt, Artificial Sequence
  Synthetic Oligonucleotide
gagauuuuuaagaagauuggcucuacc

SEQ ID NO: 3283 - RNA, 27 nt, Artificial Sequence
  Synthetic Oligonucleotide
gauuuuuaagaagauuggcucuaaaac

SEQ ID NO: 3284 - RNA, 27 nt, Artificial Sequence
  Synthetic Oligonucleotide
acuagcagaguuauaugaauauaagcc

SEQ ID NO: 3285 - RNA, 27 nt, Artificial Sequence
  Synthetic Oligonucleotide
uagcagaguuauaugaauauaagaaac

SEQ ID NO: 3286 - RNA, 27 nt, Artificial Sequence
  Synthetic Oligonucleotide
gcagaguuauaugaauauaagaagacc

SEQ ID NO: 3287 - RNA, 27 nt, Artificial Sequence
  Synthetic Oligonucleotide
agaguuauaugaauauaagaagaaacc

SEQ ID NO: 3288 - RNA, 27 nt, Artificial Sequence
  Synthetic Oligonucleotide
aguuauaugaauauaagaagaaauaac

SEQ ID NO: 3289 - RNA, 27 nt, Artificial Sequence
  Synthetic Oligonucleotide
uuauaugaauauaagaagaaauacuac

SEQ ID NO: 3290 - RNA, 27 nt, Artificial Sequence
  Synthetic Oligonucleotide
auaugaauauaagaagaaauacucaac

SEQ ID NO: 3291 - RNA, 27 nt, Artificial Sequence
  Synthetic Oligonucleotide
gcugacauugaaccauuucugaaaacc

SEQ ID NO: 3292 - RNA, 27 nt, Artificial Sequence
  Synthetic Oligonucleotide
ugacauugaaccauuucugaaaaauca

SEQ ID NO: 3293 - RNA, 27 nt, Artificial Sequence
  Synthetic Oligonucleotide
acauugaaccauuucugaaaaauucac

SEQ ID NO: 3294 - RNA, 27 nt, Artificial Sequence
  Synthetic Oligonucleotide
auugaaccauuucugaaaaauuccuac

SEQ ID NO: 3295 - RNA, 27 nt, Artificial Sequence
  Synthetic Oligonucleotide
ugaaccauuucugaaaaauuccucaac

SEQ ID NO: 3296 - RNA, 27 nt, Artificial Sequence
  Synthetic Oligonucleotide
aaccauuucugaaaaauuccucacaac

SEQ ID NO: 3297 - RNA, 27 nt, Artificial Sequence
  Synthetic Oligonucleotide
aaagaggccuucgggugauugagauaa

SEQ ID NO: 3298 - RNA, 27 nt, Artificial Sequence
  Synthetic Oligonucleotide
agaggccuucgggugauugagauggca

SEQ ID NO: 3299 - RNA, 27 nt, Artificial Sequence
  Synthetic Oligonucleotide
aggccuucgggugauugagauggagca

SEQ ID NO: 3300 - RNA, 27 nt, Artificial Sequence
  Synthetic Oligonucleotide
gccuucgggugauugagauggagagaa

SEQ ID NO: 3301 - RNA, 27 nt, Artificial Sequence
  Synthetic Oligonucleotide
cuucgggugauugagauggagagggca

SEQ ID NO: 3302 - RNA, 27 nt, Artificial Sequence
  Synthetic Oligonucleotide
ucgggugauugagauggagagggagaa

SEQ ID NO: 3303 - RNA, 27 nt, Artificial Sequence
  Synthetic Oligonucleotide
ggccaucugucuacuuggaaaggcucc

SEQ ID NO: 3304 - RNA, 27 nt, Artificial Sequence
  Synthetic Oligonucleotide
ccaucugucuacuuggaaaggcuaaca

SEQ ID NO: 3305 - RNA, 27 nt, Artificial Sequence
  Synthetic Oligonucleotide
aucugucuacuuggaaaggcuaaagcc

SEQ ID NO: 3306 - RNA, 27 nt, Artificial Sequence
  Synthetic Oligonucleotide
cugucuacuuggaaaggcuaaagauaa

SEQ ID NO: 3307 - RNA, 27 nt, Artificial Sequence
  Synthetic Oligonucleotide
uuugaccucuuugcucuccaaaccaaa

SEQ ID NO: 3308 - RNA, 27 nt, Artificial Sequence
  Synthetic Oligonucleotide
ugaccucuuugcucuccaaaccagcca

SEQ ID NO: 3309 - RNA, 27 nt, Artificial Sequence
  Synthetic Oligonucleotide
accucuuugcucuccaaaccagcagcc

SEQ ID NO: 3310 - RNA, 27 nt, Artificial Sequence
  Synthetic Oligonucleotide
cucuuugcucuccaaaccagcaguuaa

SEQ ID NO: 3311 - RNA, 27 nt, Artificial Sequence
  Synthetic Oligonucleotide
ugugaccuccuccuccuccacagcucc

SEQ ID NO: 3312 - RNA, 27 nt, Artificial Sequence
  Synthetic Oligonucleotide
aaagacuggagagaauaaagagcagca

SEQ ID NO: 3313 - RNA, 27 nt, Artificial Sequence
  Synthetic Oligonucleotide
agacuggagagaauaaagagcagucaa

SEQ ID NO: 3314 - RNA, 27 nt, Artificial Sequence
  Synthetic Oligonucleotide
acuggagagaauaaagagcagucgccc

SEQ ID NO: 3315 - RNA, 27 nt, Artificial Sequence
  Synthetic Oligonucleotide
uggagagaauaaagagcagucgcaacc

SEQ ID NO: 3316 - RNA, 27 nt, Artificial Sequence
  Synthetic Oligonucleotide
gagagaauaaagagcagucgcaaauac

SEQ ID NO: 3317 - RNA, 27 nt, Artificial Sequence
  Synthetic Oligonucleotide
gagaauaaagagcagucgcaaaugaca

SEQ ID NO: 3318 - RNA, 27 nt, Artificial Sequence
  Synthetic Oligonucleotide
gaauaaagagcagucgcaaaugaagac

SEQ ID NO: 3319 - RNA, 27 nt, Artificial Sequence
  Synthetic Oligonucleotide
auaaagagcagucgcaaaugaagcuaa

SEQ ID NO: 3320 - RNA, 27 nt, Artificial Sequence
  Synthetic Oligonucleotide
aaagagcagucgcaaaugaagcugcaa

SEQ ID NO: 3321 - RNA, 27 nt, Artificial Sequence
  Synthetic Oligonucleotide
acaaacugguuguauguaucaugccac

SEQ ID NO: 3322 - RNA, 27 nt, Artificial Sequence
  Synthetic Oligonucleotide
ugcucauuuguaaaauuguccuaauac

SEQ ID NO: 3323 - RNA, 27 nt, Artificial Sequence
  Synthetic Oligonucleotide
cucauuuguaaaauuguccuaaucucc

SEQ ID NO: 3324 - RNA, 27 nt, Artificial Sequence
  Synthetic Oligonucleotide
cauuuguaaaauuguccuaaucuuuaa

SEQ ID NO: 3325 - RNA, 27 nt, Artificial Sequence
  Synthetic Oligonucleotide
ucacuguauucuguaugaaugcaugaa

SEQ ID NO: 3326 - RNA, 27 nt, Artificial Sequence
  Synthetic Oligonucleotide
acuguauucuguaugaaugcauggccc

SEQ ID NO: 3327 - RNA, 27 nt, Artificial Sequence
  Synthetic Oligonucleotide
uguauucuguaugaaugcauggcauac

SEQ ID NO: 3328 - RNA, 27 nt, Artificial Sequence
  Synthetic Oligonucleotide
uauucuguaugaaugcauggcaugacc

SEQ ID NO: 3329 - RNA, 27 nt, Artificial Sequence
  Synthetic Oligonucleotide
uucuguaugaaugcauggcaugauaac

SEQ ID NO: 3330 - RNA, 27 nt, Artificial Sequence
  Synthetic Oligonucleotide
cuguaugaaugcauggcaugauacaca

SEQ ID NO: 3331 - RNA, 27 nt, Artificial Sequence
  Synthetic Oligonucleotide
ucuuuuauaaauaaaguuugcauuaca

SEQ ID NO: 3332 - RNA, 27 nt, Artificial Sequence
  Synthetic Oligonucleotide
uuuuauaaauaaaguuugcauuaaccc

SEQ ID NO: 3333 - RNA, 27 nt, Artificial Sequence
  Synthetic Oligonucleotide
uuauaaauaaaguuugcauuaacuacc

SEQ ID NO: 3334 - RNA, 27 nt, Artificial Sequence
  Synthetic Oligonucleotide
auaaauaaaguuugcauuaacuauaaa

SEQ ID NO: 3335 - RNA, 27 nt, Artificial Sequence
  Synthetic Oligonucleotide
aaauaaaguuugcauuaacuauaccca

SEQ ID NO: 3336 - RNA, 27 nt, Artificial Sequence
  Synthetic Oligonucleotide
auaaaguuugcauuaacuauaccugca

SEQ ID NO: 3337 - RNA, 27 nt, Artificial Sequence
  Synthetic Oligonucleotide
cccagcugaggaaauacucuuaauuac

SEQ ID NO: 3338 - RNA, 27 nt, Artificial Sequence
  Synthetic Oligonucleotide
gguugaaacugccaguugaucagaacc

SEQ ID NO: 3339 - RNA, 27 nt, Artificial Sequence
  Synthetic Oligonucleotide
cugccaguugaucagaaaugugaacca

SEQ ID NO: 3340 - RNA, 27 nt, Artificial Sequence
  Synthetic Oligonucleotide
uggaaagcaagguuaaguggguaugcc

SEQ ID NO: 3341 - RNA, 27 nt, Artificial Sequence
  Synthetic Oligonucleotide
cccagagugguccaaauuuuuaggacc

SEQ ID NO: 3342 - RNA, 27 nt, Artificial Sequence
  Synthetic Oligonucleotide
cagugguucaauugaaaggauuagaca

SEQ ID NO: 3343 - RNA, 27 nt, Artificial Sequence
  Synthetic Oligonucleotide
aggauuagaagcugcacuuguuuauac

SEQ ID NO: 3344 - RNA, 27 nt, Artificial Sequence
  Synthetic Oligonucleotide
agcugcacuuguuuauguugaaaauaa

SEQ ID NO: 3345 - RNA, 27 nt, Artificial Sequence
  Synthetic Oligonucleotide
agcaggaaaaaccacaggagaaguuac

SEQ ID NO: 3346 - RNA, 27 nt, Artificial Sequence
  Synthetic Oligonucleotide
gucagguguuguaaguaagguguuccc

SEQ ID NO: 3347 - RNA, 27 nt, Artificial Sequence
  Synthetic Oligonucleotide
guguuguaaguaagguguucaaucaca

SEQ ID NO: 3348 - RNA, 27 nt, Artificial Sequence
  Synthetic Oligonucleotide
guucaaucaaccuaaagcuaaagcccc

SEQ ID NO: 3349 - RNA, 27 nt, Artificial Sequence
  Synthetic Oligonucleotide
cuccugaaaggcuuggacaauaagacc

SEQ ID NO: 3350 - RNA, 27 nt, Artificial Sequence
  Synthetic Oligonucleotide
uuaagccaauuaucaaaguguugcccc

SEQ ID NO: 3351 - RNA, 27 nt, Artificial Sequence
  Synthetic Oligonucleotide
ucaaaguguugccaaaacucuuugaac

SEQ ID NO: 3352 - RNA, 27 nt, Artificial Sequence
  Synthetic Oligonucleotide
gccaaaacucuuugagucucgagagcc

SEQ ID NO: 3353 - RNA, 27 nt, Artificial Sequence
  Synthetic Oligonucleotide
ggcuguucgagaugaagccaaacuacc

SEQ ID NO: 3354 - RNA, 27 nt, Artificial Sequence
  Synthetic Oligonucleotide
cccauuacaaaauauaaacucuguuac

SEQ ID NO: 3355 - RNA, 27 nt, Artificial Sequence
  Synthetic Oligonucleotide
acaaaauauaaacucuguucaguugcc

SEQ ID NO: 3356 - RNA, 27 nt, Artificial Sequence
  Synthetic Oligonucleotide
auauaaacucuguucaguugaaagaca

SEQ ID NO: 3357 - RNA, 27 nt, Artificial Sequence
  Synthetic Oligonucleotide
cucuguucaguugaaagaacuagaaac

SEQ ID NO: 3358 - RNA, 27 nt, Artificial Sequence
  Synthetic Oligonucleotide
gugaugaggugccacaaauagaugccc

SEQ ID NO: 3359 - RNA, 27 nt, Artificial Sequence
  Synthetic Oligonucleotide
acaaauagaugcuuaugagcuuuuaac

SEQ ID NO: 3360 - RNA, 27 nt, Artificial Sequence
  Synthetic Oligonucleotide
uuaugagcuuuuagaagcuguagaacc

SEQ ID NO: 3361 - RNA, 27 nt, Artificial Sequence
  Synthetic Oligonucleotide
ggcccuggagucuguagaaguacuacc

SEQ ID NO: 3362 - RNA, 27 nt, Artificial Sequence
  Synthetic Oligonucleotide
uggagucuguagaaguacuaauaaacc

SEQ ID NO: 3363 - RNA, 27 nt, Artificial Sequence
  Synthetic Oligonucleotide
ugcagauuuaguaaaagcauuaaagcc

SEQ ID NO: 3364 - RNA, 27 nt, Artificial Sequence
  Synthetic Oligonucleotide
guaaaagcauuaaagaagguuguugac

SEQ ID NO: 3365 - RNA, 27 nt, Artificial Sequence
  Synthetic Oligonucleotide
agcauuaaagaagguuguuggaaagac

SEQ ID NO: 3366 - RNA, 27 nt, Artificial Sequence
  Synthetic Oligonucleotide
aagaagguuguuggaaaggacaccacc

SEQ ID NO: 3367 - RNA, 27 nt, Artificial Sequence
  Synthetic Oligonucleotide
aaggaagaaauuuggacaauaugcaaa

SEQ ID NO: 3368 - RNA, 27 nt, Artificial Sequence
  Synthetic Oligonucleotide
cagugaggauguuuuagcaguaaugac

SEQ ID NO: 3369 - RNA, 27 nt, Artificial Sequence
  Synthetic Oligonucleotide
auguuuuagcaguaauggauaauaacc

SEQ ID NO: 3370 - RNA, 27 nt, Artificial Sequence
  Synthetic Oligonucleotide
aucaagcagcagacaucucuuuuuacc

SEQ ID NO: 3371 - RNA, 27 nt, Artificial Sequence
  Synthetic Oligonucleotide
cagacaucucuuuuuauugcaagaaac

SEQ ID NO: 3372 - RNA, 27 nt, Artificial Sequence
  Synthetic Oligonucleotide
agucagagaugccgcauuugaagcacc

SEQ ID NO: 3373 - RNA, 27 nt, Artificial Sequence
  Synthetic Oligonucleotide
agcauuggguacugcuuugaaggugac

SEQ ID NO: 3374 - RNA, 27 nt, Artificial Sequence
  Synthetic Oligonucleotide
auguggacaaacucaagcuugauaaac

SEQ ID NO: 3375 - RNA, 27 nt, Artificial Sequence
  Synthetic Oligonucleotide
caaagaauguucagaaaagguagaaac

SEQ ID NO: 3376 - RNA, 27 nt, Artificial Sequence
  Synthetic Oligonucleotide
guucagaaaagguagaacugauacaca

SEQ ID NO: 3377 - RNA, 27 nt, Artificial Sequence
  Synthetic Oligonucleotide
aagguagaacugauacaugguaagacc

SEQ ID NO: 3378 - RNA, 27 nt, Artificial Sequence
  Synthetic Oligonucleotide
cgcagggaauacuggaaccaagaaccc

SEQ ID NO: 3379 - RNA, 27 nt, Artificial Sequence
  Synthetic Oligonucleotide
agccugagcucucgauagaaguaugca

SEQ ID NO: 3380 - RNA, 27 nt, Artificial Sequence
  Synthetic Oligonucleotide
cucgauagaaguaugugaagaaaaaaa

SEQ ID NO: 3381 - RNA, 27 nt, Artificial Sequence
  Synthetic Oligonucleotide
uucuugacagcaguaacuggaaagacc

SEQ ID NO: 3382 - RNA, 27 nt, Artificial Sequence
  Synthetic Oligonucleotide
gagcuaauggaccgaacugaaaugcac

SEQ ID NO: 3383 - RNA, 27 nt, Artificial Sequence
  Synthetic Oligonucleotide
cauuagugaggaugcuagccaagaaca

SEQ ID NO: 3384 - RNA, 27 nt, Artificial Sequence
  Synthetic Oligonucleotide
uagccaagaaaccuggauggaaagacc

SEQ ID NO: 3385 - RNA, 27 nt, Artificial Sequence
  Synthetic Oligonucleotide
aagaaaccuggauggaaagaaacuacc

SEQ ID NO: 3386 - RNA, 27 nt, Artificial Sequence
  Synthetic Oligonucleotide
aggugaugcaaaugaagcuucauauca

SEQ ID NO: 3387 - RNA, 27 nt, Artificial Sequence
  Synthetic Oligonucleotide
caaaacgucagcucagguuguauuaac

SEQ ID NO: 3388 - RNA, 27 nt, Artificial Sequence
  Synthetic Oligonucleotide
ugcaaaagaagcuaugacagcaauaaa

SEQ ID NO: 3389 - RNA, 27 nt, Artificial Sequence
  Synthetic Oligonucleotide
gacagcaauagccgaagccuguaugcc

SEQ ID NO: 3390 - RNA, 27 nt, Artificial Sequence
  Synthetic Oligonucleotide
ccgaagccuguauguuaccauggacca

SEQ ID NO: 3391 - RNA, 27 nt, Artificial Sequence
  Synthetic Oligonucleotide
caaaaaucagucagaaacucugaauca

SEQ ID NO: 3392 - RNA, 27 nt, Artificial Sequence
  Synthetic Oligonucleotide
aaagcuuucauuagcaaugugaagaac

SEQ ID NO: 3393 - RNA, 27 nt, Artificial Sequence
  Synthetic Oligonucleotide
uugagaagaugcagggacaaaguccca

SEQ ID NO: 3394 - RNA, 27 nt, Artificial Sequence
  Synthetic Oligonucleotide
gagcaaugaugucguugaucuuuugaa

SEQ ID NO: 3395 - RNA, 27 nt, Artificial Sequence
  Synthetic Oligonucleotide
augaaguggcagguauuauuaaugaaa

SEQ ID NO: 3396 - RNA, 27 nt, Artificial Sequence
  Synthetic Oligonucleotide
cugccuugaagggucgacucaaugacc

SEQ ID NO: 3397 - RNA, 27 nt, Artificial Sequence
  Synthetic Oligonucleotide
uugaagggucgacucaaugauucaacc

SEQ ID NO: 3398 - RNA, 27 nt, Artificial Sequence
  Synthetic Oligonucleotide
ucgacucaaugauucaaauaaaauccc

SEQ ID NO: 3399 - RNA, 27 nt, Artificial Sequence
  Synthetic Oligonucleotide
caaugauucaaauaaaaucuugguaac

SEQ ID NO: 3400 - RNA, 27 nt, Artificial Sequence
  Synthetic Oligonucleotide
guagccaugggcccaaauauuaagccc

SEQ ID NO: 3401 - RNA, 27 nt, Artificial Sequence
  Synthetic Oligonucleotide
ccaaauauuaagcaacauguaaaaacc

SEQ ID NO: 3402 - RNA, 27 nt, Artificial Sequence
  Synthetic Oligonucleotide
guccuuggagacagcaagaacaaugcc

SEQ ID NO: 3403 - RNA, 27 nt, Artificial Sequence
  Synthetic Oligonucleotide
uggagacagcaagaacaauguucgaaa

SEQ ID NO: 3404 - RNA, 27 nt, Artificial Sequence
  Synthetic Oligonucleotide
uucaugaugcauuuaggauaugaaacc

SEQ ID NO: 3405 - RNA, 27 nt, Artificial Sequence
  Synthetic Oligonucleotide
ugcuagagaaagccaaaguuaacauaa

SEQ ID NO: 3406 - RNA, 27 nt, Artificial Sequence
  Synthetic Oligonucleotide
aagggaagaagaugccaagcaaaacac

SEQ ID NO: 3407 - RNA, 27 nt, Artificial Sequence
  Synthetic Oligonucleotide
uggaaaagagcaaaggaugaaagauac

SEQ ID NO: 3408 - RNA, 27 nt, Artificial Sequence
  Synthetic Oligonucleotide
aagagcaaaggaugaaagaugaaaaca

SEQ ID NO: 3409 - RNA, 27 nt, Artificial Sequence
  Synthetic Oligonucleotide
acgggaugaauacauugagcaacuacc

SEQ ID NO: 3410 - RNA, 27 nt, Artificial Sequence
  Synthetic Oligonucleotide
augaauacauugagcaacuaaagacca

SEQ ID NO: 3411 - RNA, 27 nt, Artificial Sequence
  Synthetic Oligonucleotide
aaaguggcuuacccugagguuuuuuac

SEQ ID NO: 3412 - RNA, 27 nt, Artificial Sequence
  Synthetic Oligonucleotide
acccugagguuuuuugacaccaauaac

SEQ ID NO: 3413 - RNA, 27 nt, Artificial Sequence
  Synthetic Oligonucleotide
accaauacaagcguccugaugaaagac

SEQ ID NO: 3414 - RNA, 27 nt, Artificial Sequence
  Synthetic Oligonucleotide
gcguccugaugaaagcacuagaauacc

SEQ ID NO: 3415 - RNA, 27 nt, Artificial Sequence
  Synthetic Oligonucleotide
ugaugaaagcacuagaauauuuaaacc

SEQ ID NO: 3416 - RNA, 27 nt, Artificial Sequence
  Synthetic Oligonucleotide
uggaaaucuuucugaaaaggauaugca

SEQ ID NO: 3417 - RNA, 27 nt, Artificial Sequence
  Synthetic Oligonucleotide
cugaaaaggauaugagcaugcucgaaa

SEQ ID NO: 3418 - RNA, 27 nt, Artificial Sequence
  Synthetic Oligonucleotide
aagcuccaaugccaacauguuacgccc

SEQ ID NO: 3419 - RNA, 27 nt, Artificial Sequence
  Synthetic Oligonucleotide
ccaaugccaacauguuacgcaagggca

SEQ ID NO: 3420 - RNA, 27 nt, Artificial Sequence
  Synthetic Oligonucleotide
augugaaaugccagaacuuguucagac

SEQ ID NO: 3421 - RNA, 27 nt, Artificial Sequence
  Synthetic Oligonucleotide
gccagaacuuguucagcacaaacugac

SEQ ID NO: 3422 - RNA, 27 nt, Artificial Sequence
  Synthetic Oligonucleotide
gcacaaacuggaugacauuuuugagaa

SEQ ID NO: 3423 - RNA, 27 nt, Artificial Sequence
  Synthetic Oligonucleotide
uggaugacauuuuugagccaguccucc

SEQ ID NO: 3424 - RNA, 27 nt, Artificial Sequence
  Synthetic Oligonucleotide
gacauuuuugagccaguccuuauucac

SEQ ID NO: 3425 - RNA, 27 nt, Artificial Sequence
  Synthetic Oligonucleotide
uugagccaguccuuauuccugaaccac

SEQ ID NO: 3426 - RNA, 27 nt, Artificial Sequence
  Synthetic Oligonucleotide
cacuggaguacuaaaagaccuaaugac

SEQ ID NO: 3427 - RNA, 27 nt, Artificial Sequence
  Synthetic Oligonucleotide
uggugaagguucuggagaagucagaaa

SEQ ID NO: 3428 - RNA, 27 nt, Artificial Sequence
  Synthetic Oligonucleotide
auccugagugcccuacuuguuuugcca

SEQ ID NO: 3429 - RNA, 27 nt, Artificial Sequence
  Synthetic Oligonucleotide
aacagccaguucucccaaauucucaac

SEQ ID NO: 3430 - RNA, 27 nt, Artificial Sequence
  Synthetic Oligonucleotide
gagcuuguuaugaagugucucuggaac

SEQ ID NO: 3431 - RNA, 27 nt, Artificial Sequence
  Synthetic Oligonucleotide
uucgacuguugccugauaccaucaacc

SEQ ID NO: 3432 - RNA, 27 nt, Artificial Sequence
  Synthetic Oligonucleotide
cuguugccugauaccaucaauagcacc

SEQ ID NO: 3433 - RNA, 27 nt, Artificial Sequence
  Synthetic Oligonucleotide
gccugauaccaucaauagcauuaacac

SEQ ID NO: 3434 - RNA, 27 nt, Artificial Sequence
  Synthetic Oligonucleotide
ccaucaauagcauuaaccuagacagcc

SEQ ID NO: 3435 - RNA, 27 nt, Artificial Sequence
  Synthetic Oligonucleotide
aauagcauuaaccuagacagaauuccc

SEQ ID NO: 3436 - RNA, 27 nt, Artificial Sequence
  Synthetic Oligonucleotide
cagaauucuucuggauauccacauucc

SEQ ID NO: 3437 - RNA, 27 nt, Artificial Sequence
  Synthetic Oligonucleotide
uucuggauauccacauuuucaugaaaa

SEQ ID NO: 3438 - RNA, 27 nt, Artificial Sequence
  Synthetic Oligonucleotide
ccaaagagaaacugaagcaaugcaacc

SEQ ID NO: 3439 - RNA, 27 nt, Artificial Sequence
  Synthetic Oligonucleotide
gagaaacugaagcaaugcaaaagugcc

SEQ ID NO: 3440 - RNA, 27 nt, Artificial Sequence
  Synthetic Oligonucleotide
gccggaugaugaagcacaguauggaaa

SEQ ID NO: 3441 - RNA, 27 nt, Artificial Sequence
  Synthetic Oligonucleotide
aacagaaaagggagcaucucgaauaac

SEQ ID NO: 3442 - RNA, 27 nt, Artificial Sequence
  Synthetic Oligonucleotide
aaagggagcaucucgaauagaugaacc

SEQ ID NO: 3443 - RNA, 27 nt, Artificial Sequence
  Synthetic Oligonucleotide
gagcaucucgaauagaugaaaaauccc

SEQ ID NO: 3444 - RNA, 27 nt, Artificial Sequence
  Synthetic Oligonucleotide
aagagggacuagcagaguuauaugacc

SEQ ID NO: 3445 - RNA, 27 nt, Artificial Sequence
  Synthetic Oligonucleotide
auacucagaugcugacauugaaccacc

SEQ ID NO: 3446 - RNA, 27 nt, Artificial Sequence
  Synthetic Oligonucleotide
agcauucagaccuggauucuaaccaac

SEQ ID NO: 3447 - RNA, 27 nt, Artificial Sequence
  Synthetic Oligonucleotide
cagaccuggauucuaaccagacucaac

SEQ ID NO: 3448 - RNA, 27 nt, Artificial Sequence
  Synthetic Oligonucleotide
cuggauucuaaccagacucacucuuac

SEQ ID NO: 3449 - RNA, 27 nt, Artificial Sequence
  Synthetic Oligonucleotide
cagcuaacauagacgacuugaaaaacc

SEQ ID NO: 3450 - RNA, 27 nt, Artificial Sequence
  Synthetic Oligonucleotide
aacauagacgacuugaaaaaaagacca

SEQ ID NO: 3451 - RNA, 27 nt, Artificial Sequence
  Synthetic Oligonucleotide
aacuagaaguccucauaguuuaaaaca

SEQ ID NO: 3452 - RNA, 27 nt, Artificial Sequence
  Synthetic Oligonucleotide
uggaugaguuuaguguacagacuugcc

SEQ ID NO: 3453 - RNA, 27 nt, Artificial Sequence
  Synthetic Oligonucleotide
cccagauccuuuucuuuucuuuuuacc

SEQ ID NO: 3454 - RNA, 27 nt, Artificial Sequence
  Synthetic Oligonucleotide
auugcucauuuguaaaauuguccuacc

SEQ ID NO: 3455 - RNA, 27 nt, Artificial Sequence
  Synthetic Oligonucleotide
cugaagggucacuguauucuguaugcc

SEQ ID NO: 3456 - RNA, 27 nt, Artificial Sequence
  Synthetic Oligonucleotide
gggucacuguauucuguaugaaugccc

SEQ ID NO: 3457 - RNA, 27 nt, Artificial Sequence
  Synthetic Oligonucleotide
uggaagcacaaugggagaugacaguga

SEQ ID NO: 3458 - RNA, 27 nt, Artificial Sequence
  Synthetic Oligonucleotide
gaagcacaaugggagaugacagugagu

SEQ ID NO: 3459 - RNA, 27 nt, Artificial Sequence
  Synthetic Oligonucleotide
agcacaaugggagaugacagugagugg

SEQ ID NO: 3460 - RNA, 27 nt, Artificial Sequence
  Synthetic Oligonucleotide
cacaaugggagaugacagugagugguu

SEQ ID NO: 3461 - RNA, 27 nt, Artificial Sequence
  Synthetic Oligonucleotide
caaugggagaugacagugagugguuga

SEQ ID NO: 3462 - RNA, 27 nt, Artificial Sequence
  Synthetic Oligonucleotide
augggagaugacagugagugguugaaa

SEQ ID NO: 3463 - RNA, 27 nt, Artificial Sequence
  Synthetic Oligonucleotide
gggagaugacagugagugguugaaacu

SEQ ID NO: 3464 - RNA, 27 nt, Artificial Sequence
  Synthetic Oligonucleotide
gagaugacagugagugguugaaacugc

SEQ ID NO: 3465 - RNA, 27 nt, Artificial Sequence
  Synthetic Oligonucleotide
gaugacagugagugguugaaacugcca

SEQ ID NO: 3466 - RNA, 27 nt, Artificial Sequence
  Synthetic Oligonucleotide
cugaagaucuuccagaaaauaaaggau

SEQ ID NO: 3467 - RNA, 27 nt, Artificial Sequence
  Synthetic Oligonucleotide
gaagaucuuccagaaaauaaaggauga

SEQ ID NO: 3468 - RNA, 27 nt, Artificial Sequence
  Synthetic Oligonucleotide
agaucuuccagaaaauaaaggaugaaa

SEQ ID NO: 3469 - RNA, 27 nt, Artificial Sequence
  Synthetic Oligonucleotide
aucuuccagaaaauaaaggaugaaaag

SEQ ID NO: 3470 - RNA, 27 nt, Artificial Sequence
  Synthetic Oligonucleotide
cuuccagaaaauaaaggaugaaaagag

SEQ ID NO: 3471 - RNA, 27 nt, Artificial Sequence
  Synthetic Oligonucleotide
uccagaaaauaaaggaugaaaagagcc

SEQ ID NO: 3472 - RNA, 27 nt, Artificial Sequence
  Synthetic Oligonucleotide
cagaaaauaaaggaugaaaagagccca

SEQ ID NO: 3473 - RNA, 27 nt, Artificial Sequence
  Synthetic Oligonucleotide
gaaaauaaaggaugaaaagagcccaga

SEQ ID NO: 3474 - RNA, 27 nt, Artificial Sequence
  Synthetic Oligonucleotide
gaucaaaaaauuugucacugauuccaa

SEQ ID NO: 3475 - RNA, 27 nt, Artificial Sequence
  Synthetic Oligonucleotide
ucaaaaaauuugucacugauuccaaug

SEQ ID NO: 3476 - RNA, 27 nt, Artificial Sequence
  Synthetic Oligonucleotide
aaaaaauuugucacugauuccaaugca

SEQ ID NO: 3477 - RNA, 27 nt, Artificial Sequence
  Synthetic Oligonucleotide
aaaauuugucacugauuccaaugcagu

SEQ ID NO: 3478 - RNA, 27 nt, Artificial Sequence
  Synthetic Oligonucleotide
aauuugucacugauuccaaugcagugg

SEQ ID NO: 3479 - RNA, 27 nt, Artificial Sequence
  Synthetic Oligonucleotide
uuugucacugauuccaaugcagugguu

SEQ ID NO: 3480 - RNA, 27 nt, Artificial Sequence
  Synthetic Oligonucleotide
ugucacugauuccaaugcagugguuca

SEQ ID NO: 3481 - RNA, 27 nt, Artificial Sequence
  Synthetic Oligonucleotide
ucacugauuccaaugcagugguucaau

SEQ ID NO: 3482 - RNA, 27 nt, Artificial Sequence
  Synthetic Oligonucleotide
acugauuccaaugcagugguucaauug

SEQ ID NO: 3483 - RNA, 27 nt, Artificial Sequence
  Synthetic Oligonucleotide
ugauuccaaugcagugguucaauugaa

SEQ ID NO: 3484 - RNA, 27 nt, Artificial Sequence
  Synthetic Oligonucleotide
auuccaaugcagugguucaauugaaag

SEQ ID NO: 3485 - RNA, 27 nt, Artificial Sequence
  Synthetic Oligonucleotide
uccaaugcagugguucaauugaaagga

SEQ ID NO: 3486 - RNA, 27 nt, Artificial Sequence
  Synthetic Oligonucleotide
caaugcagugguucaauugaaaggauu

SEQ ID NO: 3487 - RNA, 27 nt, Artificial Sequence
  Synthetic Oligonucleotide
augcagugguucaauugaaaggauuag

SEQ ID NO: 3488 - RNA, 27 nt, Artificial Sequence
  Synthetic Oligonucleotide
gcagugguucaauugaaaggauuagaa

SEQ ID NO: 3489 - RNA, 27 nt, Artificial Sequence
  Synthetic Oligonucleotide
ccaagaucauaguggccuguauagaga

SEQ ID NO: 3490 - RNA, 27 nt, Artificial Sequence
  Synthetic Oligonucleotide
aagaucauaguggccuguauagagaca

SEQ ID NO: 3491 - RNA, 27 nt, Artificial Sequence
  Synthetic Oligonucleotide
gaucauaguggccuguauagagacacu

SEQ ID NO: 3492 - RNA, 27 nt, Artificial Sequence
  Synthetic Oligonucleotide
gacacugaggaaagccuuaagugaauu

SEQ ID NO: 3493 - RNA, 27 nt, Artificial Sequence
  Synthetic Oligonucleotide
cacugaggaaagccuuaagugaauuug

SEQ ID NO: 3494 - RNA, 27 nt, Artificial Sequence
  Synthetic Oligonucleotide
cugaggaaagccuuaagugaauuuggu

SEQ ID NO: 3495 - RNA, 27 nt, Artificial Sequence
  Synthetic Oligonucleotide
gaggaaagccuuaagugaauuugguuc

SEQ ID NO: 3496 - RNA, 27 nt, Artificial Sequence
  Synthetic Oligonucleotide
ggaaagccuuaagugaauuugguucca

SEQ ID NO: 3497 - RNA, 27 nt, Artificial Sequence
  Synthetic Oligonucleotide
aaagccuuaagugaauuugguuccaaa

SEQ ID NO: 3498 - RNA, 27 nt, Artificial Sequence
  Synthetic Oligonucleotide
agccuuaagugaauuugguuccaaaau

SEQ ID NO: 3499 - RNA, 27 nt, Artificial Sequence
  Synthetic Oligonucleotide
ccuuaagugaauuugguuccaaaauca

SEQ ID NO: 3500 - RNA, 27 nt, Artificial Sequence
  Synthetic Oligonucleotide
uuaagugaauuugguuccaaaaucauc

SEQ ID NO: 3501 - RNA, 27 nt, Artificial Sequence
  Synthetic Oligonucleotide
aagugaauuugguuccaaaaucaucuu

SEQ ID NO: 3502 - RNA, 27 nt, Artificial Sequence
  Synthetic Oligonucleotide
gugaauuugguuccaaaaucaucuugc

SEQ ID NO: 3503 - RNA, 27 nt, Artificial Sequence
  Synthetic Oligonucleotide
gaauuugguuccaaaaucaucuugcuu

SEQ ID NO: 3504 - RNA, 27 nt, Artificial Sequence
  Synthetic Oligonucleotide
uucguucccaacaagaacuagaagcua

SEQ ID NO: 3505 - RNA, 27 nt, Artificial Sequence
  Synthetic Oligonucleotide
cguucccaacaagaacuagaagcuaaa

SEQ ID NO: 3506 - RNA, 27 nt, Artificial Sequence
  Synthetic Oligonucleotide
uucccaacaagaacuagaagcuaaauu

SEQ ID NO: 3507 - RNA, 27 nt, Artificial Sequence
  Synthetic Oligonucleotide
cccaacaagaacuagaagcuaaauugg

SEQ ID NO: 3508 - RNA, 27 nt, Artificial Sequence
  Synthetic Oligonucleotide
caacaagaacuagaagcuaaauuggaa

SEQ ID NO: 3509 - RNA, 27 nt, Artificial Sequence
  Synthetic Oligonucleotide
acaacagucugcugguggagaugcuga

SEQ ID NO: 3510 - RNA, 27 nt, Artificial Sequence
  Synthetic Oligonucleotide
aacagucugcugguggagaugcugaag

SEQ ID NO: 3511 - RNA, 27 nt, Artificial Sequence
  Synthetic Oligonucleotide
agguggugaugauggugaugaggugcc

SEQ ID NO: 3512 - RNA, 27 nt, Artificial Sequence
  Synthetic Oligonucleotide
guggugaugauggugaugaggugccac

SEQ ID NO: 3513 - RNA, 27 nt, Artificial Sequence
  Synthetic Oligonucleotide
aaauccuuuccaaacuucccaaagacu

SEQ ID NO: 3514 - RNA, 27 nt, Artificial Sequence
  Synthetic Oligonucleotide
auccuuuccaaacuucccaaagacuuu

SEQ ID NO: 3515 - RNA, 27 nt, Artificial Sequence
  Synthetic Oligonucleotide
ccuuuccaaacuucccaaagacuuuua

SEQ ID NO: 3516 - RNA, 27 nt, Artificial Sequence
  Synthetic Oligonucleotide
uuuccaaacuucccaaagacuuuuaug

SEQ ID NO: 3517 - RNA, 27 nt, Artificial Sequence
  Synthetic Oligonucleotide
uccaaacuucccaaagacuuuuaugac

SEQ ID NO: 3518 - RNA, 27 nt, Artificial Sequence
  Synthetic Oligonucleotide
caaacuucccaaagacuuuuaugacaa

SEQ ID NO: 3519 - RNA, 27 nt, Artificial Sequence
  Synthetic Oligonucleotide
aacuucccaaagacuuuuaugacaaaa

SEQ ID NO: 3520 - RNA, 27 nt, Artificial Sequence
  Synthetic Oligonucleotide
cuucccaaagacuuuuaugacaaaauu

SEQ ID NO: 3521 - RNA, 27 nt, Artificial Sequence
  Synthetic Oligonucleotide
ucccaaagacuuuuaugacaaaauuga

SEQ ID NO: 3522 - RNA, 27 nt, Artificial Sequence
  Synthetic Oligonucleotide
ccaaagacuuuuaugacaaaauugagg

SEQ ID NO: 3523 - RNA, 27 nt, Artificial Sequence
  Synthetic Oligonucleotide
aaagacuuuuaugacaaaauugaggca

SEQ ID NO: 3524 - RNA, 27 nt, Artificial Sequence
  Synthetic Oligonucleotide
agacuuuuaugacaaaauugaggcaaa

SEQ ID NO: 3525 - RNA, 27 nt, Artificial Sequence
  Synthetic Oligonucleotide
acuuuuaugacaaaauugaggcaaaaa

SEQ ID NO: 3526 - RNA, 27 nt, Artificial Sequence
  Synthetic Oligonucleotide
uuuuaugacaaaauugaggcaaaaaaa

SEQ ID NO: 3527 - RNA, 27 nt, Artificial Sequence
  Synthetic Oligonucleotide
uuaugacaaaauugaggcaaaaaaaug

SEQ ID NO: 3528 - RNA, 27 nt, Artificial Sequence
  Synthetic Oligonucleotide
aaaauggcaagagagaaaagaggcccu

SEQ ID NO: 3529 - RNA, 27 nt, Artificial Sequence
  Synthetic Oligonucleotide
gaagguuguuggaaaggacaccaaugu

SEQ ID NO: 3530 - RNA, 27 nt, Artificial Sequence
  Synthetic Oligonucleotide
agguuguuggaaaggacaccaauguca

SEQ ID NO: 3531 - RNA, 27 nt, Artificial Sequence
  Synthetic Oligonucleotide
guuguuggaaaggacaccaaugucaug

SEQ ID NO: 3532 - RNA, 27 nt, Artificial Sequence
  Synthetic Oligonucleotide
uguuggaaaggacaccaaugucauguu

SEQ ID NO: 3533 - RNA, 27 nt, Artificial Sequence
  Synthetic Oligonucleotide
uuggaaaggacaccaaugucauguugg

SEQ ID NO: 3534 - RNA, 27 nt, Artificial Sequence
  Synthetic Oligonucleotide
ggaaaggacaccaaugucauguuggug

SEQ ID NO: 3535 - RNA, 27 nt, Artificial Sequence
  Synthetic Oligonucleotide
aaaggacaccaaugucauguugguggc

SEQ ID NO: 3536 - RNA, 27 nt, Artificial Sequence
  Synthetic Oligonucleotide
aggacaccaaugucauguugguggcuu

SEQ ID NO: 3537 - RNA, 27 nt, Artificial Sequence
  Synthetic Oligonucleotide
uggcuuuggcagcaaaaugucuuacug

SEQ ID NO: 3538 - RNA, 27 nt, Artificial Sequence
  Synthetic Oligonucleotide
gcuuuggcagcaaaaugucuuacuggc

SEQ ID NO: 3539 - RNA, 27 nt, Artificial Sequence
  Synthetic Oligonucleotide
uuuggcagcaaaaugucuuacuggccu

SEQ ID NO: 3540 - RNA, 27 nt, Artificial Sequence
  Synthetic Oligonucleotide
uggcagcaaaaugucuuacuggccugg

SEQ ID NO: 3541 - RNA, 27 nt, Artificial Sequence
  Synthetic Oligonucleotide
gcagcaaaaugucuuacuggccuggcu

SEQ ID NO: 3542 - RNA, 27 nt, Artificial Sequence
  Synthetic Oligonucleotide
gaagaaauuuggacaauaugcaggaca

SEQ ID NO: 3543 - RNA, 27 nt, Artificial Sequence
  Synthetic Oligonucleotide
agaaauuuggacaauaugcaggacaug

SEQ ID NO: 3544 - RNA, 27 nt, Artificial Sequence
  Synthetic Oligonucleotide
aaauuuggacaauaugcaggacauguu

SEQ ID NO: 3545 - RNA, 27 nt, Artificial Sequence
  Synthetic Oligonucleotide
auuuggacaauaugcaggacauguugu

SEQ ID NO: 3546 - RNA, 27 nt, Artificial Sequence
  Synthetic Oligonucleotide
uuggacaauaugcaggacauguugugc

SEQ ID NO: 3547 - RNA, 27 nt, Artificial Sequence
  Synthetic Oligonucleotide
ggacaauaugcaggacauguugugcca

SEQ ID NO: 3548 - RNA, 27 nt, Artificial Sequence
  Synthetic Oligonucleotide
acaauaugcaggacauguugugccaac

SEQ ID NO: 3549 - RNA, 27 nt, Artificial Sequence
  Synthetic Oligonucleotide
aauaugcaggacauguugugccaacca

SEQ ID NO: 3550 - RNA, 27 nt, Artificial Sequence
  Synthetic Oligonucleotide
uaugcaggacauguugugccaaccauc

SEQ ID NO: 3551 - RNA, 27 nt, Artificial Sequence
  Synthetic Oligonucleotide
ugcaggacauguugugccaaccaucuu

SEQ ID NO: 3552 - RNA, 27 nt, Artificial Sequence
  Synthetic Oligonucleotide
accucaagugguacaagcccugcagga

SEQ ID NO: 3553 - RNA, 27 nt, Artificial Sequence
  Synthetic Oligonucleotide
cucaagugguacaagcccugcaggagg

SEQ ID NO: 3554 - RNA, 27 nt, Artificial Sequence
  Synthetic Oligonucleotide
caagugguacaagcccugcaggaggca

SEQ ID NO: 3555 - RNA, 27 nt, Artificial Sequence
  Synthetic Oligonucleotide
agugguacaagcccugcaggaggcaau

SEQ ID NO: 3556 - RNA, 27 nt, Artificial Sequence
  Synthetic Oligonucleotide
ugguacaagcccugcaggaggcaauug

SEQ ID NO: 3557 - RNA, 27 nt, Artificial Sequence
  Synthetic Oligonucleotide
guacaagcccugcaggaggcaauugau

SEQ ID NO: 3558 - RNA, 27 nt, Artificial Sequence
  Synthetic Oligonucleotide
acaagcccugcaggaggcaauugaugc

SEQ ID NO: 3559 - RNA, 27 nt, Artificial Sequence
  Synthetic Oligonucleotide
aagcccugcaggaggcaauugaugcaa

SEQ ID NO: 3560 - RNA, 27 nt, Artificial Sequence
  Synthetic Oligonucleotide
gcccugcaggaggcaauugaugcaauc

SEQ ID NO: 3561 - RNA, 27 nt, Artificial Sequence
  Synthetic Oligonucleotide
ccugcaggaggcaauugaugcaaucuu

SEQ ID NO: 3562 - RNA, 27 nt, Artificial Sequence
  Synthetic Oligonucleotide
ugcaggaggcaauugaugcaaucuucc

SEQ ID NO: 3563 - RNA, 27 nt, Artificial Sequence
  Synthetic Oligonucleotide
caggaggcaauugaugcaaucuuccuu

SEQ ID NO: 3564 - RNA, 27 nt, Artificial Sequence
  Synthetic Oligonucleotide
ggaggcaauugaugcaaucuuccuuac

SEQ ID NO: 3565 - RNA, 27 nt, Artificial Sequence
  Synthetic Oligonucleotide
aggcaauugaugcaaucuuccuuacua

SEQ ID NO: 3566 - RNA, 27 nt, Artificial Sequence
  Synthetic Oligonucleotide
uuacuaccacacuacagaacaucagug

SEQ ID NO: 3567 - RNA, 27 nt, Artificial Sequence
  Synthetic Oligonucleotide
acuaccacacuacagaacaucagugag

SEQ ID NO: 3568 - RNA, 27 nt, Artificial Sequence
  Synthetic Oligonucleotide
uaccacacuacagaacaucagugagga

SEQ ID NO: 3569 - RNA, 27 nt, Artificial Sequence
  Synthetic Oligonucleotide
ccacacuacagaacaucagugaggaug

SEQ ID NO: 3570 - RNA, 27 nt, Artificial Sequence
  Synthetic Oligonucleotide
acacuacagaacaucagugaggauguu

SEQ ID NO: 3571 - RNA, 27 nt, Artificial Sequence
  Synthetic Oligonucleotide
acuacagaacaucagugaggauguuuu

SEQ ID NO: 3572 - RNA, 27 nt, Artificial Sequence
  Synthetic Oligonucleotide
uacagaacaucagugaggauguuuuag

SEQ ID NO: 3573 - RNA, 27 nt, Artificial Sequence
  Synthetic Oligonucleotide
uuuuagcaguaauggauaauaaaaauc

SEQ ID NO: 3574 - RNA, 27 nt, Artificial Sequence
  Synthetic Oligonucleotide
uuagcaguaauggauaauaaaaaucca

SEQ ID NO: 3575 - RNA, 27 nt, Artificial Sequence
  Synthetic Oligonucleotide
agcaguaauggauaauaaaaauccaac

SEQ ID NO: 3576 - RNA, 27 nt, Artificial Sequence
  Synthetic Oligonucleotide
caguaauggauaauaaaaauccaacca

SEQ ID NO: 3577 - RNA, 27 nt, Artificial Sequence
  Synthetic Oligonucleotide
caaccaucaagcagcagacaucucuuu

SEQ ID NO: 3578 - RNA, 27 nt, Artificial Sequence
  Synthetic Oligonucleotide
cacuacuuaagcacaucaaugauucug

SEQ ID NO: 3579 - RNA, 27 nt, Artificial Sequence
  Synthetic Oligonucleotide
cuacuuaagcacaucaaugauucugcu

SEQ ID NO: 3580 - RNA, 27 nt, Artificial Sequence
  Synthetic Oligonucleotide
acuuaagcacaucaaugauucugcucc

SEQ ID NO: 3581 - RNA, 27 nt, Artificial Sequence
  Synthetic Oligonucleotide
uuaagcacaucaaugauucugcuccug

SEQ ID NO: 3582 - RNA, 27 nt, Artificial Sequence
  Synthetic Oligonucleotide
aagcacaucaaugauucugcuccugaa

SEQ ID NO: 3583 - RNA, 27 nt, Artificial Sequence
  Synthetic Oligonucleotide
gcacaucaaugauucugcuccugaagu

SEQ ID NO: 3584 - RNA, 27 nt, Artificial Sequence
  Synthetic Oligonucleotide
acaucaaugauucugcuccugaaguca

SEQ ID NO: 3585 - RNA, 27 nt, Artificial Sequence
  Synthetic Oligonucleotide
aucaaugauucugcuccugaagucaga

SEQ ID NO: 3586 - RNA, 27 nt, Artificial Sequence
  Synthetic Oligonucleotide
caaugauucugcuccugaagucagaga

SEQ ID NO: 3587 - RNA, 27 nt, Artificial Sequence
  Synthetic Oligonucleotide
augauucugcuccugaagucagagaug

SEQ ID NO: 3588 - RNA, 27 nt, Artificial Sequence
  Synthetic Oligonucleotide
gauucugcuccugaagucagagaugcc

SEQ ID NO: 3589 - RNA, 27 nt, Artificial Sequence
  Synthetic Oligonucleotide
uucugcuccugaagucagagaugccgc

SEQ ID NO: 3590 - RNA, 27 nt, Artificial Sequence
  Synthetic Oligonucleotide
cugcuccugaagucagagaugccgcau

SEQ ID NO: 3591 - RNA, 27 nt, Artificial Sequence
  Synthetic Oligonucleotide
aagaucaaagaauguucagaaaaggua

SEQ ID NO: 3592 - RNA, 27 nt, Artificial Sequence
  Synthetic Oligonucleotide
gaucaaagaauguucagaaaagguaga

SEQ ID NO: 3593 - RNA, 27 nt, Artificial Sequence
  Synthetic Oligonucleotide
gaaaccuggauggaaagaaacuaauuu

SEQ ID NO: 3594 - RNA, 27 nt, Artificial Sequence
  Synthetic Oligonucleotide
aaccuggauggaaagaaacuaauuuuc

SEQ ID NO: 3595 - RNA, 27 nt, Artificial Sequence
  Synthetic Oligonucleotide
ccuggauggaaagaaacuaauuuucag

SEQ ID NO: 3596 - RNA, 27 nt, Artificial Sequence
  Synthetic Oligonucleotide
uggauggaaagaaacuaauuuucaggu

SEQ ID NO: 3597 - RNA, 27 nt, Artificial Sequence
  Synthetic Oligonucleotide
gauggaaagaaacuaauuuucagguga

SEQ ID NO: 3598 - RNA, 27 nt, Artificial Sequence
  Synthetic Oligonucleotide
uggaaagaaacuaauuuucaggugaug

SEQ ID NO: 3599 - RNA, 27 nt, Artificial Sequence
  Synthetic Oligonucleotide
gaaagaaacuaauuuucaggugaugca

SEQ ID NO: 3600 - RNA, 27 nt, Artificial Sequence
  Synthetic Oligonucleotide
aagaaacuaauuuucaggugaugcaaa

SEQ ID NO: 3601 - RNA, 27 nt, Artificial Sequence
  Synthetic Oligonucleotide
gaaacuaauuuucaggugaugcaaaug

SEQ ID NO: 3602 - RNA, 27 nt, Artificial Sequence
  Synthetic Oligonucleotide
aacuaauuuucaggugaugcaaaugaa

SEQ ID NO: 3603 - RNA, 27 nt, Artificial Sequence
  Synthetic Oligonucleotide
aguugcuuugauugcccagaagggaaa

SEQ ID NO: 3604 - RNA, 27 nt, Artificial Sequence
  Synthetic Oligonucleotide
uugcuuugauugcccagaagggaaauu

SEQ ID NO: 3605 - RNA, 27 nt, Artificial Sequence
  Synthetic Oligonucleotide
gcuuugauugcccagaagggaaauuuu

SEQ ID NO: 3606 - RNA, 27 nt, Artificial Sequence
  Synthetic Oligonucleotide
uuugauugcccagaagggaaauuuuuc

SEQ ID NO: 3607 - RNA, 27 nt, Artificial Sequence
  Synthetic Oligonucleotide
ugauugcccagaagggaaauuuuucca

SEQ ID NO: 3608 - RNA, 27 nt, Artificial Sequence
  Synthetic Oligonucleotide
auugcccagaagggaaauuuuuccaaa

SEQ ID NO: 3609 - RNA, 27 nt, Artificial Sequence
  Synthetic Oligonucleotide
ugcccagaagggaaauuuuuccaaaac

SEQ ID NO: 3610 - RNA, 27 nt, Artificial Sequence
  Synthetic Oligonucleotide
uggacaagauuggagaugugaaaugug

SEQ ID NO: 3611 - RNA, 27 nt, Artificial Sequence
  Synthetic Oligonucleotide
gacaagauuggagaugugaaauguggg

SEQ ID NO: 3612 - RNA, 27 nt, Artificial Sequence
  Synthetic Oligonucleotide
caagauuggagaugugaaaugugggaa

SEQ ID NO: 3613 - RNA, 27 nt, Artificial Sequence
  Synthetic Oligonucleotide
agauuggagaugugaaaugugggaaca

SEQ ID NO: 3614 - RNA, 27 nt, Artificial Sequence
  Synthetic Oligonucleotide
auuggagaugugaaaugugggaacaau

SEQ ID NO: 3615 - RNA, 27 nt, Artificial Sequence
  Synthetic Oligonucleotide
uggagaugugaaaugugggaacaaugc

SEQ ID NO: 3616 - RNA, 27 nt, Artificial Sequence
  Synthetic Oligonucleotide
gagaugugaaaugugggaacaaugcaa

SEQ ID NO: 3617 - RNA, 27 nt, Artificial Sequence
  Synthetic Oligonucleotide
gaugugaaaugugggaacaaugcaaaa

SEQ ID NO: 3618 - RNA, 27 nt, Artificial Sequence
  Synthetic Oligonucleotide
ugugaaaugugggaacaaugcaaaaga

SEQ ID NO: 3619 - RNA, 27 nt, Artificial Sequence
  Synthetic Oligonucleotide
ugaaaugugggaacaaugcaaaagaag

SEQ ID NO: 3620 - RNA, 27 nt, Artificial Sequence
  Synthetic Oligonucleotide
aaaugugggaacaaugcaaaagaagcu

SEQ ID NO: 3621 - RNA, 27 nt, Artificial Sequence
  Synthetic Oligonucleotide
augugggaacaaugcaaaagaagcuau

SEQ ID NO: 3622 - RNA, 27 nt, Artificial Sequence
  Synthetic Oligonucleotide
gugggaacaaugcaaaagaagcuauga

SEQ ID NO: 3623 - RNA, 27 nt, Artificial Sequence
  Synthetic Oligonucleotide
ggguugaaugucaaagcuuucauuagc

SEQ ID NO: 3624 - RNA, 27 nt, Artificial Sequence
  Synthetic Oligonucleotide
guugaaugucaaagcuuucauuagcaa

SEQ ID NO: 3625 - RNA, 27 nt, Artificial Sequence
  Synthetic Oligonucleotide
ugaaugucaaagcuuucauuagcaaug

SEQ ID NO: 3626 - RNA, 27 nt, Artificial Sequence
  Synthetic Oligonucleotide
aaugucaaagcuuucauuagcaaugug

SEQ ID NO: 3627 - RNA, 27 nt, Artificial Sequence
  Synthetic Oligonucleotide
ugucaaagcuuucauuagcaaugugaa

SEQ ID NO: 3628 - RNA, 27 nt, Artificial Sequence
  Synthetic Oligonucleotide
aacccugcuuggcgugauguaucugua

SEQ ID NO: 3629 - RNA, 27 nt, Artificial Sequence
  Synthetic Oligonucleotide
cccugcuuggcgugauguaucuguaug

SEQ ID NO: 3630 - RNA, 27 nt, Artificial Sequence
  Synthetic Oligonucleotide
guucuuugaggaugagaagccugcccu

SEQ ID NO: 3631 - RNA, 27 nt, Artificial Sequence
  Synthetic Oligonucleotide
ucuuugaggaugagaagccugcccucc

SEQ ID NO: 3632 - RNA, 27 nt, Artificial Sequence
  Synthetic Oligonucleotide
uuugaggaugagaagccugcccuccua

SEQ ID NO: 3633 - RNA, 27 nt, Artificial Sequence
  Synthetic Oligonucleotide
ugaggaugagaagccugcccuccuauc

SEQ ID NO: 3634 - RNA, 27 nt, Artificial Sequence
  Synthetic Oligonucleotide
aggaugagaagccugcccuccuauccc

SEQ ID NO: 3635 - RNA, 27 nt, Artificial Sequence
  Synthetic Oligonucleotide
gaugagaagccugcccuccuaucccag

SEQ ID NO: 3636 - RNA, 27 nt, Artificial Sequence
  Synthetic Oligonucleotide
ugagaagccugcccuccuaucccagau

SEQ ID NO: 3637 - RNA, 27 nt, Artificial Sequence
  Synthetic Oligonucleotide
agaagccugcccuccuaucccagauag

SEQ ID NO: 3638 - RNA, 27 nt, Artificial Sequence
  Synthetic Oligonucleotide
aagccugcccuccuaucccagauagau

SEQ ID NO: 3639 - RNA, 27 nt, Artificial Sequence
  Synthetic Oligonucleotide
gccugcccuccuaucccagauagaugc

SEQ ID NO: 3640 - RNA, 27 nt, Artificial Sequence
  Synthetic Oligonucleotide
cugcccuccuaucccagauagaugcag

SEQ ID NO: 3641 - RNA, 27 nt, Artificial Sequence
  Synthetic Oligonucleotide
gcccuccuaucccagauagaugcagaa

SEQ ID NO: 3642 - RNA, 27 nt, Artificial Sequence
  Synthetic Oligonucleotide
ccuccuaucccagauagaugcagaauu

SEQ ID NO: 3643 - RNA, 27 nt, Artificial Sequence
  Synthetic Oligonucleotide
uccuaucccagauagaugcagaauuug

SEQ ID NO: 3644 - RNA, 27 nt, Artificial Sequence
  Synthetic Oligonucleotide
cuaucccagauagaugcagaauuugag

SEQ ID NO: 3645 - RNA, 27 nt, Artificial Sequence
  Synthetic Oligonucleotide
aucccagauagaugcagaauuugagaa

SEQ ID NO: 3646 - RNA, 27 nt, Artificial Sequence
  Synthetic Oligonucleotide
agaagaugcagggacaaaguccaccug

SEQ ID NO: 3647 - RNA, 27 nt, Artificial Sequence
  Synthetic Oligonucleotide
gguacagaugaaggagaagauggagau

SEQ ID NO: 3648 - RNA, 27 nt, Artificial Sequence
  Synthetic Oligonucleotide
uacagaugaaggagaagauggagauga

SEQ ID NO: 3649 - RNA, 27 nt, Artificial Sequence
  Synthetic Oligonucleotide
cagaugaaggagaagauggagaugaac

SEQ ID NO: 3650 - RNA, 27 nt, Artificial Sequence
  Synthetic Oligonucleotide
ucguugaucuuuugccgaggacggaga

SEQ ID NO: 3651 - RNA, 27 nt, Artificial Sequence
  Synthetic Oligonucleotide
uaggaaagaaggccuagaugaaguggc

SEQ ID NO: 3652 - RNA, 27 nt, Artificial Sequence
  Synthetic Oligonucleotide
ggaaagaaggccuagaugaaguggcag

SEQ ID NO: 3653 - RNA, 27 nt, Artificial Sequence
  Synthetic Oligonucleotide
aaagaaggccuagaugaaguggcaggu

SEQ ID NO: 3654 - RNA, 27 nt, Artificial Sequence
  Synthetic Oligonucleotide
agaaggccuagaugaaguggcagguau

SEQ ID NO: 3655 - RNA, 27 nt, Artificial Sequence
  Synthetic Oligonucleotide
aaggccuagaugaaguggcagguauua

SEQ ID NO: 3656 - RNA, 27 nt, Artificial Sequence
  Synthetic Oligonucleotide
ggccuagaugaaguggcagguauuauu

SEQ ID NO: 3657 - RNA, 27 nt, Artificial Sequence
  Synthetic Oligonucleotide
ccuagaugaaguggcagguauuauuaa

SEQ ID NO: 3658 - RNA, 27 nt, Artificial Sequence
  Synthetic Oligonucleotide
uagaugaaguggcagguauuauuaaug

SEQ ID NO: 3659 - RNA, 27 nt, Artificial Sequence
  Synthetic Oligonucleotide
cgaauauaggugaacuuccaacugccu

SEQ ID NO: 3660 - RNA, 27 nt, Artificial Sequence
  Synthetic Oligonucleotide
aauauaggugaacuuccaacugccuug

SEQ ID NO: 3661 - RNA, 27 nt, Artificial Sequence
  Synthetic Oligonucleotide
uauaggugaacuuccaacugccuugaa

SEQ ID NO: 3662 - RNA, 27 nt, Artificial Sequence
  Synthetic Oligonucleotide
uaggugaacuuccaacugccuugaagg

SEQ ID NO: 3663 - RNA, 27 nt, Artificial Sequence
  Synthetic Oligonucleotide
ggugaacuuccaacugccuugaagggu

SEQ ID NO: 3664 - RNA, 27 nt, Artificial Sequence
  Synthetic Oligonucleotide
ugaacuuccaacugccuugaagggucg

SEQ ID NO: 3665 - RNA, 27 nt, Artificial Sequence
  Synthetic Oligonucleotide
aacuuccaacugccuugaagggucgac

SEQ ID NO: 3666 - RNA, 27 nt, Artificial Sequence
  Synthetic Oligonucleotide
cuuccaacugccuugaagggucgacuc

SEQ ID NO: 3667 - RNA, 27 nt, Artificial Sequence
  Synthetic Oligonucleotide
uccaacugccuugaagggucgacucaa

SEQ ID NO: 3668 - RNA, 27 nt, Artificial Sequence
  Synthetic Oligonucleotide
caacugccuugaagggucgacucaaug

SEQ ID NO: 3669 - RNA, 27 nt, Artificial Sequence
  Synthetic Oligonucleotide
aacaacuggcaguagccaugggcccaa

SEQ ID NO: 3670 - RNA, 27 nt, Artificial Sequence
  Synthetic Oligonucleotide
acagcaagaacaauguucgagcugcug

SEQ ID NO: 3671 - RNA, 27 nt, Artificial Sequence
  Synthetic Oligonucleotide
agcaagaacaauguucgagcugcugcc

SEQ ID NO: 3672 - RNA, 27 nt, Artificial Sequence
  Synthetic Oligonucleotide
caagaacaauguucgagcugcugcccu

SEQ ID NO: 3673 - RNA, 27 nt, Artificial Sequence
  Synthetic Oligonucleotide
agaacaauguucgagcugcugcccuag

SEQ ID NO: 3674 - RNA, 27 nt, Artificial Sequence
  Synthetic Oligonucleotide
aacaauguucgagcugcugcccuagcg

SEQ ID NO: 3675 - RNA, 27 nt, Artificial Sequence
  Synthetic Oligonucleotide
caauguucgagcugcugcccuagcgac

SEQ ID NO: 3676 - RNA, 27 nt, Artificial Sequence
  Synthetic Oligonucleotide
auguucgagcugcugcccuagcgacug

SEQ ID NO: 3677 - RNA, 27 nt, Artificial Sequence
  Synthetic Oligonucleotide
cgacugugaaugcuugggcagaacaga

SEQ ID NO: 3678 - RNA, 27 nt, Artificial Sequence
  Synthetic Oligonucleotide
acugugaaugcuugggcagaacagacu

SEQ ID NO: 3679 - RNA, 27 nt, Artificial Sequence
  Synthetic Oligonucleotide
ugugaaugcuugggcagaacagacugg

SEQ ID NO: 3680 - RNA, 27 nt, Artificial Sequence
  Synthetic Oligonucleotide
aggagaagaucuuucugaagagcucaa

SEQ ID NO: 3681 - RNA, 27 nt, Artificial Sequence
  Synthetic Oligonucleotide
gccuagaagaucgaaauggagaugugc

SEQ ID NO: 3682 - RNA, 27 nt, Artificial Sequence
  Synthetic Oligonucleotide
cuagaagaucgaaauggagaugugcga

SEQ ID NO: 3683 - RNA, 27 nt, Artificial Sequence
  Synthetic Oligonucleotide
agaagaucgaaauggagaugugcgaaa

SEQ ID NO: 3684 - RNA, 27 nt, Artificial Sequence
  Synthetic Oligonucleotide
caugaugcauuuaggauaugaaaaaau

SEQ ID NO: 3685 - RNA, 27 nt, Artificial Sequence
  Synthetic Oligonucleotide
ugaugcauuuaggauaugaaaaaaugg

SEQ ID NO: 3686 - RNA, 27 nt, Artificial Sequence
  Synthetic Oligonucleotide
augcauuuaggauaugaaaaaauggcc

SEQ ID NO: 3687 - RNA, 27 nt, Artificial Sequence
  Synthetic Oligonucleotide
gcauuuaggauaugaaaaaauggccaa

SEQ ID NO: 3688 - RNA, 27 nt, Artificial Sequence
  Synthetic Oligonucleotide
auuuaggauaugaaaaaauggccaagg

SEQ ID NO: 3689 - RNA, 27 nt, Artificial Sequence
  Synthetic Oligonucleotide
ccaaggcuacugggaaacuaaagccaa

SEQ ID NO: 3690 - RNA, 27 nt, Artificial Sequence
  Synthetic Oligonucleotide
aaggcuacugggaaacuaaagccaacu

SEQ ID NO: 3691 - RNA, 27 nt, Artificial Sequence
  Synthetic Oligonucleotide
ggcuacugggaaacuaaagccaacuuc

SEQ ID NO: 3692 - RNA, 27 nt, Artificial Sequence
  Synthetic Oligonucleotide
cuacugggaaacuaaagccaacuucua

SEQ ID NO: 3693 - RNA, 27 nt, Artificial Sequence
  Synthetic Oligonucleotide
acugggaaacuaaagccaacuucuaaa

SEQ ID NO: 3694 - RNA, 27 nt, Artificial Sequence
  Synthetic Oligonucleotide
ugggaaacuaaagccaacuucuaaaga

SEQ ID NO: 3695 - RNA, 27 nt, Artificial Sequence
  Synthetic Oligonucleotide
ggaaacuaaagccaacuucuaaagauc

SEQ ID NO: 3696 - RNA, 27 nt, Artificial Sequence
  Synthetic Oligonucleotide
aaacuaaagccaacuucuaaagaucag

SEQ ID NO: 3697 - RNA, 27 nt, Artificial Sequence
  Synthetic Oligonucleotide
acuaaagccaacuucuaaagaucaggu

SEQ ID NO: 3698 - RNA, 27 nt, Artificial Sequence
  Synthetic Oligonucleotide
uaaagccaacuucuaaagaucagguau

SEQ ID NO: 3699 - RNA, 27 nt, Artificial Sequence
  Synthetic Oligonucleotide
ggccuauuuuuauuguuguuccaaaug

SEQ ID NO: 3700 - RNA, 27 nt, Artificial Sequence
  Synthetic Oligonucleotide
ccuauuuuuauuguuguuccaaaugga

SEQ ID NO: 3701 - RNA, 27 nt, Artificial Sequence
  Synthetic Oligonucleotide
uauuuuuauuguuguuccaaauggaaa

SEQ ID NO: 3702 - RNA, 27 nt, Artificial Sequence
  Synthetic Oligonucleotide
uuuuuauuguuguuccaaauggaaaag

SEQ ID NO: 3703 - RNA, 27 nt, Artificial Sequence
  Synthetic Oligonucleotide
uuuauuguuguuccaaauggaaaagag

SEQ ID NO: 3704 - RNA, 27 nt, Artificial Sequence
  Synthetic Oligonucleotide
uauuguuguuccaaauggaaaagagca

SEQ ID NO: 3705 - RNA, 27 nt, Artificial Sequence
  Synthetic Oligonucleotide
gaaggugcuaaaguggaauuuuacuac

SEQ ID NO: 3706 - RNA, 27 nt, Artificial Sequence
  Synthetic Oligonucleotide
aggugcuaaaguggaauuuuacuaccc

SEQ ID NO: 3707 - RNA, 27 nt, Artificial Sequence
  Synthetic Oligonucleotide
auaucaucuuacugagaaugaagcauc

SEQ ID NO: 3708 - RNA, 27 nt, Artificial Sequence
  Synthetic Oligonucleotide
aucaucuuacugagaaugaagcaucuu

SEQ ID NO: 3709 - RNA, 27 nt, Artificial Sequence
  Synthetic Oligonucleotide
caucuuacugagaaugaagcaucuucc

SEQ ID NO: 3710 - RNA, 27 nt, Artificial Sequence
  Synthetic Oligonucleotide
ucuuacugagaaugaagcaucuuccuu

SEQ ID NO: 3711 - RNA, 27 nt, Artificial Sequence
  Synthetic Oligonucleotide
gucaagguuggagaaccaaaggauguc

SEQ ID NO: 3712 - RNA, 27 nt, Artificial Sequence
  Synthetic Oligonucleotide
caagguuggagaaccaaaggaugucau

SEQ ID NO: 3713 - RNA, 27 nt, Artificial Sequence
  Synthetic Oligonucleotide
agguuggagaaccaaaggaugucauuc

SEQ ID NO: 3714 - RNA, 27 nt, Artificial Sequence
  Synthetic Oligonucleotide
guuggagaaccaaaggaugucauucgu

SEQ ID NO: 3715 - RNA, 27 nt, Artificial Sequence
  Synthetic Oligonucleotide
uggagaaccaaaggaugucauucguaa

SEQ ID NO: 3716 - RNA, 27 nt, Artificial Sequence
  Synthetic Oligonucleotide
gagaaccaaaggaugucauucguaaag

SEQ ID NO: 3717 - RNA, 27 nt, Artificial Sequence
  Synthetic Oligonucleotide
gaaccaaaggaugucauucguaaagau

SEQ ID NO: 3718 - RNA, 27 nt, Artificial Sequence
  Synthetic Oligonucleotide
accaaaggaugucauucguaaagaugu

SEQ ID NO: 3719 - RNA, 27 nt, Artificial Sequence
  Synthetic Oligonucleotide
caaaggaugucauucguaaagauguuc

SEQ ID NO: 3720 - RNA, 27 nt, Artificial Sequence
  Synthetic Oligonucleotide
aaggaugucauucguaaagauguucgu

SEQ ID NO: 3721 - RNA, 27 nt, Artificial Sequence
  Synthetic Oligonucleotide
ggaugucauucguaaagauguucgugc

SEQ ID NO: 3722 - RNA, 27 nt, Artificial Sequence
  Synthetic Oligonucleotide
cauccugaaccggaugugccuugucua

SEQ ID NO: 3723 - RNA, 27 nt, Artificial Sequence
  Synthetic Oligonucleotide
uccugaaccggaugugccuugucuacc

SEQ ID NO: 3724 - RNA, 27 nt, Artificial Sequence
  Synthetic Oligonucleotide
cugaaccggaugugccuugucuaccca

SEQ ID NO: 3725 - RNA, 27 nt, Artificial Sequence
  Synthetic Oligonucleotide
gaaccggaugugccuugucuacccagc

SEQ ID NO: 3726 - RNA, 27 nt, Artificial Sequence
  Synthetic Oligonucleotide
accggaugugccuugucuacccagcua

SEQ ID NO: 3727 - RNA, 27 nt, Artificial Sequence
  Synthetic Oligonucleotide
cggaugugccuugucuacccagcuagc

SEQ ID NO: 3728 - RNA, 27 nt, Artificial Sequence
  Synthetic Oligonucleotide
gaugugccuugucuacccagcuagcaa

SEQ ID NO: 3729 - RNA, 27 nt, Artificial Sequence
  Synthetic Oligonucleotide
auccaaaaacucuaagcagagagcaga

SEQ ID NO: 3730 - RNA, 27 nt, Artificial Sequence
  Synthetic Oligonucleotide
ccaaaaacucuaagcagagagcagagu

SEQ ID NO: 3731 - RNA, 27 nt, Artificial Sequence
  Synthetic Oligonucleotide
aaaaacucuaagcagagagcagagugc

SEQ ID NO: 3732 - RNA, 27 nt, Artificial Sequence
  Synthetic Oligonucleotide
aaacucuaagcagagagcagagugccu

SEQ ID NO: 3733 - RNA, 27 nt, Artificial Sequence
  Synthetic Oligonucleotide
acucuaagcagagagcagagugccugg

SEQ ID NO: 3734 - RNA, 27 nt, Artificial Sequence
  Synthetic Oligonucleotide
ucuaagcagagagcagagugccuggaa

SEQ ID NO: 3735 - RNA, 27 nt, Artificial Sequence
  Synthetic Oligonucleotide
uaagcagagagcagagugccuggaaga

SEQ ID NO: 3736 - RNA, 27 nt, Artificial Sequence
  Synthetic Oligonucleotide
agcagagagcagagugccuggaagagc

SEQ ID NO: 3737 - RNA, 27 nt, Artificial Sequence
  Synthetic Oligonucleotide
cagagagcagagugccuggaagagcug

SEQ ID NO: 3738 - RNA, 27 nt, Artificial Sequence
  Synthetic Oligonucleotide
gagagcagagugccuggaagagcuggg

SEQ ID NO: 3739 - RNA, 27 nt, Artificial Sequence
  Synthetic Oligonucleotide
gagcagagugccuggaagagcugggau

SEQ ID NO: 3740 - RNA, 27 nt, Artificial Sequence
  Synthetic Oligonucleotide
cccaggaaaagccuuaaaggaaauagc

SEQ ID NO: 3741 - RNA, 27 nt, Artificial Sequence
  Synthetic Oligonucleotide
ggaucagguguucaaacugauuggaaa

SEQ ID NO: 3742 - RNA, 27 nt, Artificial Sequence
  Synthetic Oligonucleotide
aucagguguucaaacugauuggaaauc

SEQ ID NO: 3743 - RNA, 27 nt, Artificial Sequence
  Synthetic Oligonucleotide
cagguguucaaacugauuggaaaucuu

SEQ ID NO: 3744 - RNA, 27 nt, Artificial Sequence
  Synthetic Oligonucleotide
gguguucaaacugauuggaaaucuuuc

SEQ ID NO: 3745 - RNA, 27 nt, Artificial Sequence
  Synthetic Oligonucleotide
uguucaaacugauuggaaaucuuucug

SEQ ID NO: 3746 - RNA, 27 nt, Artificial Sequence
  Synthetic Oligonucleotide
uucaaacugauuggaaaucuuucugaa

SEQ ID NO: 3747 - RNA, 27 nt, Artificial Sequence
  Synthetic Oligonucleotide
caaacugauuggaaaucuuucugaaaa

SEQ ID NO: 3748 - RNA, 27 nt, Artificial Sequence
  Synthetic Oligonucleotide
aacugauuggaaaucuuucugaaaagg

SEQ ID NO: 3749 - RNA, 27 nt, Artificial Sequence
  Synthetic Oligonucleotide
uuaagcggucagcaaagagacccucug

SEQ ID NO: 3750 - RNA, 27 nt, Artificial Sequence
  Synthetic Oligonucleotide
aagcggucagcaaagagacccucugcu

SEQ ID NO: 3751 - RNA, 27 nt, Artificial Sequence
  Synthetic Oligonucleotide
gcggucagcaaagagacccucugcugc

SEQ ID NO: 3752 - RNA, 27 nt, Artificial Sequence
  Synthetic Oligonucleotide
ggucagcaaagagacccucugcugcac

SEQ ID NO: 3753 - RNA, 27 nt, Artificial Sequence
  Synthetic Oligonucleotide
ucagcaaagagacccucugcugcacca

SEQ ID NO: 3754 - RNA, 27 nt, Artificial Sequence
  Synthetic Oligonucleotide
agcaaagagacccucugcugcaccaau

SEQ ID NO: 3755 - RNA, 27 nt, Artificial Sequence
  Synthetic Oligonucleotide
caaagagacccucugcugcaccaauaa

SEQ ID NO: 3756 - RNA, 27 nt, Artificial Sequence
  Synthetic Oligonucleotide
guuacgcaagggaccagcugaggacau

SEQ ID NO: 3757 - RNA, 27 nt, Artificial Sequence
  Synthetic Oligonucleotide
uacgcaagggaccagcugaggacaugu

SEQ ID NO: 3758 - RNA, 27 nt, Artificial Sequence
  Synthetic Oligonucleotide
uccgccgagaauuccagcuggaucuag

SEQ ID NO: 3759 - RNA, 27 nt, Artificial Sequence
  Synthetic Oligonucleotide
cgccgagaauuccagcuggaucuagau

SEQ ID NO: 3760 - RNA, 27 nt, Artificial Sequence
  Synthetic Oligonucleotide
caagauccgggcuguuucuccacacuu

SEQ ID NO: 3761 - RNA, 27 nt, Artificial Sequence
  Synthetic Oligonucleotide
agauccgggcuguuucuccacacuucg

SEQ ID NO: 3762 - RNA, 27 nt, Artificial Sequence
  Synthetic Oligonucleotide
ucgaugacaugcacaguaauacagcau

SEQ ID NO: 3763 - RNA, 27 nt, Artificial Sequence
  Synthetic Oligonucleotide
gaugacaugcacaguaauacagcaucc

SEQ ID NO: 3764 - RNA, 27 nt, Artificial Sequence
  Synthetic Oligonucleotide
ugacaugcacaguaauacagcauccac

SEQ ID NO: 3765 - RNA, 27 nt, Artificial Sequence
  Synthetic Oligonucleotide
acaugcacaguaauacagcauccacaa

SEQ ID NO: 3766 - RNA, 27 nt, Artificial Sequence
  Synthetic Oligonucleotide
augcacaguaauacagcauccacaauc

SEQ ID NO: 3767 - RNA, 27 nt, Artificial Sequence
  Synthetic Oligonucleotide
gcacaguaauacagcauccacaaucaa

SEQ ID NO: 3768 - RNA, 27 nt, Artificial Sequence
  Synthetic Oligonucleotide
acaguaauacagcauccacaaucaauu

SEQ ID NO: 3769 - RNA, 27 nt, Artificial Sequence
  Synthetic Oligonucleotide
aguaauacagcauccacaaucaauuuc

SEQ ID NO: 3770 - RNA, 27 nt, Artificial Sequence
  Synthetic Oligonucleotide
uaauacagcauccacaaucaauuucau

SEQ ID NO: 3771 - RNA, 27 nt, Artificial Sequence
  Synthetic Oligonucleotide
auacagcauccacaaucaauuucauua

SEQ ID NO: 3772 - RNA, 27 nt, Artificial Sequence
  Synthetic Oligonucleotide
acagcauccacaaucaauuucauuauc

SEQ ID NO: 3773 - RNA, 27 nt, Artificial Sequence
  Synthetic Oligonucleotide
agcauccacaaucaauuucauuaucuc

SEQ ID NO: 3774 - RNA, 27 nt, Artificial Sequence
  Synthetic Oligonucleotide
cauccacaaucaauuucauuaucuccc

SEQ ID NO: 3775 - RNA, 27 nt, Artificial Sequence
  Synthetic Oligonucleotide
uccacaaucaauuucauuaucucccaa

SEQ ID NO: 3776 - RNA, 27 nt, Artificial Sequence
  Synthetic Oligonucleotide
cacaaucaauuucauuaucucccaagu

SEQ ID NO: 3777 - RNA, 27 nt, Artificial Sequence
  Synthetic Oligonucleotide
caaucaauuucauuaucucccaaguag

SEQ ID NO: 3778 - RNA, 27 nt, Artificial Sequence
  Synthetic Oligonucleotide
aucaauuucauuaucucccaaguagcc

SEQ ID NO: 3779 - RNA, 27 nt, Artificial Sequence
  Synthetic Oligonucleotide
caauuucauuaucucccaaguagccag

SEQ ID NO: 3780 - RNA, 27 nt, Artificial Sequence
  Synthetic Oligonucleotide
auuucauuaucucccaaguagccagug

SEQ ID NO: 3781 - RNA, 27 nt, Artificial Sequence
  Synthetic Oligonucleotide
uucauuaucucccaaguagccaguggu

SEQ ID NO: 3782 - RNA, 27 nt, Artificial Sequence
  Synthetic Oligonucleotide
cauuaucucccaaguagccagugguga

SEQ ID NO: 3783 - RNA, 27 nt, Artificial Sequence
  Synthetic Oligonucleotide
uuaucucccaaguagccaguggugaca

SEQ ID NO: 3784 - RNA, 27 nt, Artificial Sequence
  Synthetic Oligonucleotide
aucucccaaguagccaguggugacauc

SEQ ID NO: 3785 - RNA, 27 nt, Artificial Sequence
  Synthetic Oligonucleotide
cucccaaguagccaguggugacaucaa

SEQ ID NO: 3786 - RNA, 27 nt, Artificial Sequence
  Synthetic Oligonucleotide
cccaaguagccaguggugacaucaaca

SEQ ID NO: 3787 - RNA, 27 nt, Artificial Sequence
  Synthetic Oligonucleotide
uugcccgggaggccuccacuggaguac

SEQ ID NO: 3788 - RNA, 27 nt, Artificial Sequence
  Synthetic Oligonucleotide
gcccgggaggccuccacuggaguacua

SEQ ID NO: 3789 - RNA, 27 nt, Artificial Sequence
  Synthetic Oligonucleotide
ccgggaggccuccacuggaguacuaaa

SEQ ID NO: 3790 - RNA, 27 nt, Artificial Sequence
  Synthetic Oligonucleotide
gggaggccuccacuggaguacuaaaag

SEQ ID NO: 3791 - RNA, 27 nt, Artificial Sequence
  Synthetic Oligonucleotide
ucaucaccuuaaugcuggauucucgga

SEQ ID NO: 3792 - RNA, 27 nt, Artificial Sequence
  Synthetic Oligonucleotide
aucaccuuaaugcuggauucucggauu

SEQ ID NO: 3793 - RNA, 27 nt, Artificial Sequence
  Synthetic Oligonucleotide
caccuuaaugcuggauucucggauuga

SEQ ID NO: 3794 - RNA, 27 nt, Artificial Sequence
  Synthetic Oligonucleotide
ccuuaaugcuggauucucggauugaag

SEQ ID NO: 3795 - RNA, 27 nt, Artificial Sequence
  Synthetic Oligonucleotide
uuaaugcuggauucucggauugaagau

SEQ ID NO: 3796 - RNA, 27 nt, Artificial Sequence
  Synthetic Oligonucleotide
aaugcuggauucucggauugaagaucu

SEQ ID NO: 3797 - RNA, 27 nt, Artificial Sequence
  Synthetic Oligonucleotide
ugcuggauucucggauugaagaucuug

SEQ ID NO: 3798 - RNA, 27 nt, Artificial Sequence
  Synthetic Oligonucleotide
cuggauucucggauugaagaucuugag

SEQ ID NO: 3799 - RNA, 27 nt, Artificial Sequence
  Synthetic Oligonucleotide
ggauucucggauugaagaucuugagga

SEQ ID NO: 3800 - RNA, 27 nt, Artificial Sequence
  Synthetic Oligonucleotide
cucugugaaccucuugguggugaaggu

SEQ ID NO: 3801 - RNA, 27 nt, Artificial Sequence
  Synthetic Oligonucleotide
cugugaaccucuugguggugaagguuc

SEQ ID NO: 3802 - RNA, 27 nt, Artificial Sequence
  Synthetic Oligonucleotide
gugaaccucuugguggugaagguucug

SEQ ID NO: 3803 - RNA, 27 nt, Artificial Sequence
  Synthetic Oligonucleotide
gaaccucuugguggugaagguucugga

SEQ ID NO: 3804 - RNA, 27 nt, Artificial Sequence
  Synthetic Oligonucleotide
aagacagccugcuagcaacagccaguu

SEQ ID NO: 3805 - RNA, 27 nt, Artificial Sequence
  Synthetic Oligonucleotide
ccaguucucccaaauucucagagcuug

SEQ ID NO: 3806 - RNA, 27 nt, Artificial Sequence
  Synthetic Oligonucleotide
aguucucccaaauucucagagcuuguu

SEQ ID NO: 3807 - RNA, 27 nt, Artificial Sequence
  Synthetic Oligonucleotide
uucucccaaauucucagagcuuguuau

SEQ ID NO: 3808 - RNA, 27 nt, Artificial Sequence
  Synthetic Oligonucleotide
cucccaaauucucagagcuuguuauga

SEQ ID NO: 3809 - RNA, 27 nt, Artificial Sequence
  Synthetic Oligonucleotide
cccaaauucucagagcuuguuaugaag

SEQ ID NO: 3810 - RNA, 27 nt, Artificial Sequence
  Synthetic Oligonucleotide
caaauucucagagcuuguuaugaagug

SEQ ID NO: 3811 - RNA, 27 nt, Artificial Sequence
  Synthetic Oligonucleotide
aauucucagagcuuguuaugaaguguc

SEQ ID NO: 3812 - RNA, 27 nt, Artificial Sequence
  Synthetic Oligonucleotide
uucucagagcuuguuaugaagugucuc

SEQ ID NO: 3813 - RNA, 27 nt, Artificial Sequence
  Synthetic Oligonucleotide
cucagagcuuguuaugaagugucucug

SEQ ID NO: 3814 - RNA, 27 nt, Artificial Sequence
  Synthetic Oligonucleotide
cagagcuuguuaugaagugucucugga

SEQ ID NO: 3815 - RNA, 27 nt, Artificial Sequence
  Synthetic Oligonucleotide
auagcauuaaccuagacagaauucuuc

SEQ ID NO: 3816 - RNA, 27 nt, Artificial Sequence
  Synthetic Oligonucleotide
agcauuaaccuagacagaauucuucug

SEQ ID NO: 3817 - RNA, 27 nt, Artificial Sequence
  Synthetic Oligonucleotide
cauuaaccuagacagaauucuucugga

SEQ ID NO: 3818 - RNA, 27 nt, Artificial Sequence
  Synthetic Oligonucleotide
uuaaccuagacagaauucuucuggaua

SEQ ID NO: 3819 - RNA, 27 nt, Artificial Sequence
  Synthetic Oligonucleotide
aaccuagacagaauucuucuggauauc

SEQ ID NO: 3820 - RNA, 27 nt, Artificial Sequence
  Synthetic Oligonucleotide
ccuagacagaauucuucuggauaucca

SEQ ID NO: 3821 - RNA, 27 nt, Artificial Sequence
  Synthetic Oligonucleotide
uauccacauuuucaugaaggucuuccc

SEQ ID NO: 3822 - RNA, 27 nt, Artificial Sequence
  Synthetic Oligonucleotide
cugaagcaaugcaaaagugaauuuccc

SEQ ID NO: 3823 - RNA, 27 nt, Artificial Sequence
  Synthetic Oligonucleotide
gaagcaaugcaaaagugaauuucccau

SEQ ID NO: 3824 - RNA, 27 nt, Artificial Sequence
  Synthetic Oligonucleotide
agcaaugcaaaagugaauuucccauaa

SEQ ID NO: 3825 - RNA, 27 nt, Artificial Sequence
  Synthetic Oligonucleotide
acaguauggaccagacugggagcaagu

SEQ ID NO: 3826 - RNA, 27 nt, Artificial Sequence
  Synthetic Oligonucleotide
aguauggaccagacugggagcaagucu

SEQ ID NO: 3827 - RNA, 27 nt, Artificial Sequence
  Synthetic Oligonucleotide
uauggaccagacugggagcaagucuga

SEQ ID NO: 3828 - RNA, 27 nt, Artificial Sequence
  Synthetic Oligonucleotide
uggaccagacugggagcaagucugaua

SEQ ID NO: 3829 - RNA, 27 nt, Artificial Sequence
  Synthetic Oligonucleotide
gaccagacugggagcaagucugauaag

SEQ ID NO: 3830 - RNA, 27 nt, Artificial Sequence
  Synthetic Oligonucleotide
ccagacugggagcaagucugauaagga

SEQ ID NO: 3831 - RNA, 27 nt, Artificial Sequence
  Synthetic Oligonucleotide
agacugggagcaagucugauaaggaaa

SEQ ID NO: 3832 - RNA, 27 nt, Artificial Sequence
  Synthetic Oligonucleotide
acugggagcaagucugauaaggaaaca

SEQ ID NO: 3833 - RNA, 27 nt, Artificial Sequence
  Synthetic Oligonucleotide
ugggagcaagucugauaaggaaacaga

SEQ ID NO: 3834 - RNA, 27 nt, Artificial Sequence
  Synthetic Oligonucleotide
ggagcaagucugauaaggaaacagaaa

SEQ ID NO: 3835 - RNA, 27 nt, Artificial Sequence
  Synthetic Oligonucleotide
agcaagucugauaaggaaacagaaaag

SEQ ID NO: 3836 - RNA, 27 nt, Artificial Sequence
  Synthetic Oligonucleotide
caagucugauaaggaaacagaaaaggg

SEQ ID NO: 3837 - RNA, 27 nt, Artificial Sequence
  Synthetic Oligonucleotide
agucugauaaggaaacagaaaagggag

SEQ ID NO: 3838 - RNA, 27 nt, Artificial Sequence
  Synthetic Oligonucleotide
ucugauaaggaaacagaaaagggagca

SEQ ID NO: 3839 - RNA, 27 nt, Artificial Sequence
  Synthetic Oligonucleotide
ugauaaggaaacagaaaagggagcauc

SEQ ID NO: 3840 - RNA, 27 nt, Artificial Sequence
  Synthetic Oligonucleotide
auaaggaaacagaaaagggagcaucuc

SEQ ID NO: 3841 - RNA, 27 nt, Artificial Sequence
  Synthetic Oligonucleotide
caucucgaauagaugaaaaaucaucaa

SEQ ID NO: 3842 - RNA, 27 nt, Artificial Sequence
  Synthetic Oligonucleotide
ucucgaauagaugaaaaaucaucaaag

SEQ ID NO: 3843 - RNA, 27 nt, Artificial Sequence
  Synthetic Oligonucleotide
ucgaauagaugaaaaaucaucaaaggc

SEQ ID NO: 3844 - RNA, 27 nt, Artificial Sequence
  Synthetic Oligonucleotide
gaauagaugaaaaaucaucaaaggcca

SEQ ID NO: 3845 - RNA, 27 nt, Artificial Sequence
  Synthetic Oligonucleotide
auagaugaaaaaucaucaaaggccaaa

SEQ ID NO: 3846 - RNA, 27 nt, Artificial Sequence
  Synthetic Oligonucleotide
agaugaaaaaucaucaaaggccaaagu

SEQ ID NO: 3847 - RNA, 27 nt, Artificial Sequence
  Synthetic Oligonucleotide
augaaaaaucaucaaaggccaaaguga

SEQ ID NO: 3848 - RNA, 27 nt, Artificial Sequence
  Synthetic Oligonucleotide
gaaaaaucaucaaaggccaaagugaau

SEQ ID NO: 3849 - RNA, 27 nt, Artificial Sequence
  Synthetic Oligonucleotide
aaaaucaucaaaggccaaagugaauga

SEQ ID NO: 3850 - RNA, 27 nt, Artificial Sequence
  Synthetic Oligonucleotide
gaaugauuucuuagcugagauuuuuaa

SEQ ID NO: 3851 - RNA, 27 nt, Artificial Sequence
  Synthetic Oligonucleotide
augauuucuuagcugagauuuuuaaga

SEQ ID NO: 3852 - RNA, 27 nt, Artificial Sequence
  Synthetic Oligonucleotide
gauuucuuagcugagauuuuuaagaag

SEQ ID NO: 3853 - RNA, 27 nt, Artificial Sequence
  Synthetic Oligonucleotide
uuucuuagcugagauuuuuaagaagau

SEQ ID NO: 3854 - RNA, 27 nt, Artificial Sequence
  Synthetic Oligonucleotide
ucuuagcugagauuuuuaagaagauug

SEQ ID NO: 3855 - RNA, 27 nt, Artificial Sequence
  Synthetic Oligonucleotide
uuagcugagauuuuuaagaagauuggc

SEQ ID NO: 3856 - RNA, 27 nt, Artificial Sequence
  Synthetic Oligonucleotide
agcugagauuuuuaagaagauuggcuc

SEQ ID NO: 3857 - RNA, 27 nt, Artificial Sequence
  Synthetic Oligonucleotide
cugagauuuuuaagaagauuggcucua

SEQ ID NO: 3858 - RNA, 27 nt, Artificial Sequence
  Synthetic Oligonucleotide
gagauuuuuaagaagauuggcucuaaa

SEQ ID NO: 3859 - RNA, 27 nt, Artificial Sequence
  Synthetic Oligonucleotide
gauuuuuaagaagauuggcucuaaaga

SEQ ID NO: 3860 - RNA, 27 nt, Artificial Sequence
  Synthetic Oligonucleotide
acuagcagaguuauaugaauauaagaa

SEQ ID NO: 3861 - RNA, 27 nt, Artificial Sequence
  Synthetic Oligonucleotide
uagcagaguuauaugaauauaagaaga

SEQ ID NO: 3862 - RNA, 27 nt, Artificial Sequence
  Synthetic Oligonucleotide
gcagaguuauaugaauauaagaagaaa

SEQ ID NO: 3863 - RNA, 27 nt, Artificial Sequence
  Synthetic Oligonucleotide
agaguuauaugaauauaagaagaaaua

SEQ ID NO: 3864 - RNA, 27 nt, Artificial Sequence
  Synthetic Oligonucleotide
aguuauaugaauauaagaagaaauacu

SEQ ID NO: 3865 - RNA, 27 nt, Artificial Sequence
  Synthetic Oligonucleotide
uuauaugaauauaagaagaaauacuca

SEQ ID NO: 3866 - RNA, 27 nt, Artificial Sequence
  Synthetic Oligonucleotide
auaugaauauaagaagaaauacucaga

SEQ ID NO: 3867 - RNA, 27 nt, Artificial Sequence
  Synthetic Oligonucleotide
gcugacauugaaccauuucugaaaaau

SEQ ID NO: 3868 - RNA, 27 nt, Artificial Sequence
  Synthetic Oligonucleotide
ugacauugaaccauuucugaaaaauuc

SEQ ID NO: 3869 - RNA, 27 nt, Artificial Sequence
  Synthetic Oligonucleotide
acauugaaccauuucugaaaaauuccu

SEQ ID NO: 3870 - RNA, 27 nt, Artificial Sequence
  Synthetic Oligonucleotide
auugaaccauuucugaaaaauuccuca

SEQ ID NO: 3871 - RNA, 27 nt, Artificial Sequence
  Synthetic Oligonucleotide
ugaaccauuucugaaaaauuccucaca

SEQ ID NO: 3872 - RNA, 27 nt, Artificial Sequence
  Synthetic Oligonucleotide
aaccauuucugaaaaauuccucacagu

SEQ ID NO: 3873 - RNA, 27 nt, Artificial Sequence
  Synthetic Oligonucleotide
aaagaggccuucgggugauugagaugg

SEQ ID NO: 3874 - RNA, 27 nt, Artificial Sequence
  Synthetic Oligonucleotide
agaggccuucgggugauugagauggag

SEQ ID NO: 3875 - RNA, 27 nt, Artificial Sequence
  Synthetic Oligonucleotide
aggccuucgggugauugagauggagag

SEQ ID NO: 3876 - RNA, 27 nt, Artificial Sequence
  Synthetic Oligonucleotide
gccuucgggugauugagauggagaggg

SEQ ID NO: 3877 - RNA, 27 nt, Artificial Sequence
  Synthetic Oligonucleotide
cuucgggugauugagauggagagggag

SEQ ID NO: 3878 - RNA, 27 nt, Artificial Sequence
  Synthetic Oligonucleotide
ucgggugauugagauggagagggaggg

SEQ ID NO: 3879 - RNA, 27 nt, Artificial Sequence
  Synthetic Oligonucleotide
ggccaucugucuacuuggaaaggcuaa

SEQ ID NO: 3880 - RNA, 27 nt, Artificial Sequence
  Synthetic Oligonucleotide
ccaucugucuacuuggaaaggcuaaag

SEQ ID NO: 3881 - RNA, 27 nt, Artificial Sequence
  Synthetic Oligonucleotide
aucugucuacuuggaaaggcuaaagau

SEQ ID NO: 3882 - RNA, 27 nt, Artificial Sequence
  Synthetic Oligonucleotide
cugucuacuuggaaaggcuaaagaucc

SEQ ID NO: 3883 - RNA, 27 nt, Artificial Sequence
  Synthetic Oligonucleotide
uuugaccucuuugcucuccaaaccagc

SEQ ID NO: 3884 - RNA, 27 nt, Artificial Sequence
  Synthetic Oligonucleotide
ugaccucuuugcucuccaaaccagcag

SEQ ID NO: 3885 - RNA, 27 nt, Artificial Sequence
  Synthetic Oligonucleotide
accucuuugcucuccaaaccagcaguu

SEQ ID NO: 3886 - RNA, 27 nt, Artificial Sequence
  Synthetic Oligonucleotide
cucuuugcucuccaaaccagcaguucc

SEQ ID NO: 3887 - RNA, 27 nt, Artificial Sequence
  Synthetic Oligonucleotide
ugugaccuccuccuccuccacagcuaa

SEQ ID NO: 3888 - RNA, 27 nt, Artificial Sequence
  Synthetic Oligonucleotide
aaagacuggagagaauaaagagcaguc

SEQ ID NO: 3889 - RNA, 27 nt, Artificial Sequence
  Synthetic Oligonucleotide
agacuggagagaauaaagagcagucgc

SEQ ID NO: 3890 - RNA, 27 nt, Artificial Sequence
  Synthetic Oligonucleotide
acuggagagaauaaagagcagucgcaa

SEQ ID NO: 3891 - RNA, 27 nt, Artificial Sequence
  Synthetic Oligonucleotide
uggagagaauaaagagcagucgcaaau

SEQ ID NO: 3892 - RNA, 27 nt, Artificial Sequence
  Synthetic Oligonucleotide
gagagaauaaagagcagucgcaaauga

SEQ ID NO: 3893 - RNA, 27 nt, Artificial Sequence
  Synthetic Oligonucleotide
gagaauaaagagcagucgcaaaugaag

SEQ ID NO: 3894 - RNA, 27 nt, Artificial Sequence
  Synthetic Oligonucleotide
gaauaaagagcagucgcaaaugaagcu

SEQ ID NO: 3895 - RNA, 27 nt, Artificial Sequence
  Synthetic Oligonucleotide
auaaagagcagucgcaaaugaagcugc

SEQ ID NO: 3896 - RNA, 27 nt, Artificial Sequence
  Synthetic Oligonucleotide
aaagagcagucgcaaaugaagcugccc

SEQ ID NO: 3897 - RNA, 27 nt, Artificial Sequence
  Synthetic Oligonucleotide
acaaacugguuguauguaucaugccgu

SEQ ID NO: 3898 - RNA, 27 nt, Artificial Sequence
  Synthetic Oligonucleotide
ugcucauuuguaaaauuguccuaaucu

SEQ ID NO: 3899 - RNA, 27 nt, Artificial Sequence
  Synthetic Oligonucleotide
cucauuuguaaaauuguccuaaucuuu

SEQ ID NO: 3900 - RNA, 27 nt, Artificial Sequence
  Synthetic Oligonucleotide
cauuuguaaaauuguccuaaucuuucc

SEQ ID NO: 3901 - RNA, 27 nt, Artificial Sequence
  Synthetic Oligonucleotide
ucacuguauucuguaugaaugcauggc

SEQ ID NO: 3902 - RNA, 27 nt, Artificial Sequence
  Synthetic Oligonucleotide
acuguauucuguaugaaugcauggcau

SEQ ID NO: 3903 - RNA, 27 nt, Artificial Sequence
  Synthetic Oligonucleotide
uguauucuguaugaaugcauggcauga

SEQ ID NO: 3904 - RNA, 27 nt, Artificial Sequence
  Synthetic Oligonucleotide
uauucuguaugaaugcauggcaugaua

SEQ ID NO: 3905 - RNA, 27 nt, Artificial Sequence
  Synthetic Oligonucleotide
uucuguaugaaugcauggcaugauaca

SEQ ID NO: 3906 - RNA, 27 nt, Artificial Sequence
  Synthetic Oligonucleotide
cuguaugaaugcauggcaugauacaac

SEQ ID NO: 3907 - RNA, 27 nt, Artificial Sequence
  Synthetic Oligonucleotide
ucuuuuauaaauaaaguuugcauuaac

SEQ ID NO: 3908 - RNA, 27 nt, Artificial Sequence
  Synthetic Oligonucleotide
uuuuauaaauaaaguuugcauuaacua

SEQ ID NO: 3909 - RNA, 27 nt, Artificial Sequence
  Synthetic Oligonucleotide
uuauaaauaaaguuugcauuaacuaua

SEQ ID NO: 3910 - RNA, 27 nt, Artificial Sequence
  Synthetic Oligonucleotide
auaaauaaaguuugcauuaacuauacc

SEQ ID NO: 3911 - RNA, 27 nt, Artificial Sequence
  Synthetic Oligonucleotide
aaauaaaguuugcauuaacuauaccug

SEQ ID NO: 3912 - RNA, 27 nt, Artificial Sequence
  Synthetic Oligonucleotide
auaaaguuugcauuaacuauaccugac

SEQ ID NO: 3913 - RNA, 27 nt, Artificial Sequence
  Synthetic Oligonucleotide
cccagcugaggaaauacucuuaauucu

SEQ ID NO: 3914 - RNA, 27 nt, Artificial Sequence
  Synthetic Oligonucleotide
gguugaaacugccaguugaucagaaau

SEQ ID NO: 3915 - RNA, 27 nt, Artificial Sequence
  Synthetic Oligonucleotide
cugccaguugaucagaaaugugaacac

SEQ ID NO: 3916 - RNA, 27 nt, Artificial Sequence
  Synthetic Oligonucleotide
uggaaagcaagguuaaguggguaugaa

SEQ ID NO: 3917 - RNA, 27 nt, Artificial Sequence
  Synthetic Oligonucleotide
cccagagugguccaaauuuuuaggauu

SEQ ID NO: 3918 - RNA, 27 nt, Artificial Sequence
  Synthetic Oligonucleotide
cagugguucaauugaaaggauuagaag

SEQ ID NO: 3919 - RNA, 27 nt, Artificial Sequence
  Synthetic Oligonucleotide
aggauuagaagcugcacuuguuuaugu

SEQ ID NO: 3920 - RNA, 27 nt, Artificial Sequence
  Synthetic Oligonucleotide
agcugcacuuguuuauguugaaaaugc

SEQ ID NO: 3921 - RNA, 27 nt, Artificial Sequence
  Synthetic Oligonucleotide
agcaggaaaaaccacaggagaaguugu

SEQ ID NO: 3922 - RNA, 27 nt, Artificial Sequence
  Synthetic Oligonucleotide
gucagguguuguaaguaagguguucaa

SEQ ID NO: 3923 - RNA, 27 nt, Artificial Sequence
  Synthetic Oligonucleotide
guguuguaaguaagguguucaaucaac

SEQ ID NO: 3924 - RNA, 27 nt, Artificial Sequence
  Synthetic Oligonucleotide
guucaaucaaccuaaagcuaaagccaa

SEQ ID NO: 3925 - RNA, 27 nt, Artificial Sequence
  Synthetic Oligonucleotide
cuccugaaaggcuuggacaauaagaau

SEQ ID NO: 3926 - RNA, 27 nt, Artificial Sequence
  Synthetic Oligonucleotide
uuaagccaauuaucaaaguguugccaa

SEQ ID NO: 3927 - RNA, 27 nt, Artificial Sequence
  Synthetic Oligonucleotide
ucaaaguguugccaaaacucuuugagu

SEQ ID NO: 3928 - RNA, 27 nt, Artificial Sequence
  Synthetic Oligonucleotide
gccaaaacucuuugagucucgagagaa

SEQ ID NO: 3929 - RNA, 27 nt, Artificial Sequence
  Synthetic Oligonucleotide
ggcuguucgagaugaagccaaacuaau

SEQ ID NO: 3930 - RNA, 27 nt, Artificial Sequence
  Synthetic Oligonucleotide
cccauuacaaaauauaaacucuguuca

SEQ ID NO: 3931 - RNA, 27 nt, Artificial Sequence
  Synthetic Oligonucleotide
acaaaauauaaacucuguucaguugaa

SEQ ID NO: 3932 - RNA, 27 nt, Artificial Sequence
  Synthetic Oligonucleotide
auauaaacucuguucaguugaaagaac

SEQ ID NO: 3933 - RNA, 27 nt, Artificial Sequence
  Synthetic Oligonucleotide
cucuguucaguugaaagaacuagaaga

SEQ ID NO: 3934 - RNA, 27 nt, Artificial Sequence
  Synthetic Oligonucleotide
gugaugaggugccacaaauagaugcuu

SEQ ID NO: 3935 - RNA, 27 nt, Artificial Sequence
  Synthetic Oligonucleotide
acaaauagaugcuuaugagcuuuuaga

SEQ ID NO: 3936 - RNA, 27 nt, Artificial Sequence
  Synthetic Oligonucleotide
uuaugagcuuuuagaagcuguagaaau

SEQ ID NO: 3937 - RNA, 27 nt, Artificial Sequence
  Synthetic Oligonucleotide
ggcccuggagucuguagaaguacuaau

SEQ ID NO: 3938 - RNA, 27 nt, Artificial Sequence
  Synthetic Oligonucleotide
uggagucuguagaaguacuaauaaaaa

SEQ ID NO: 3939 - RNA, 27 nt, Artificial Sequence
  Synthetic Oligonucleotide
ugcagauuuaguaaaagcauuaaagaa

SEQ ID NO: 3940 - RNA, 27 nt, Artificial Sequence
  Synthetic Oligonucleotide
guaaaagcauuaaagaagguuguugga

SEQ ID NO: 3941 - RNA, 27 nt, Artificial Sequence
  Synthetic Oligonucleotide
agcauuaaagaagguuguuggaaagga

SEQ ID NO: 3942 - RNA, 27 nt, Artificial Sequence
  Synthetic Oligonucleotide
aagaagguuguuggaaaggacaccaau

SEQ ID NO: 3943 - RNA, 27 nt, Artificial Sequence
  Synthetic Oligonucleotide
aaggaagaaauuuggacaauaugcagg

SEQ ID NO: 3944 - RNA, 27 nt, Artificial Sequence
  Synthetic Oligonucleotide
cagugaggauguuuuagcaguaaugga

SEQ ID NO: 3945 - RNA, 27 nt, Artificial Sequence
  Synthetic Oligonucleotide
auguuuuagcaguaauggauaauaaaa

SEQ ID NO: 3946 - RNA, 27 nt, Artificial Sequence
  Synthetic Oligonucleotide
aucaagcagcagacaucucuuuuuauu

SEQ ID NO: 3947 - RNA, 27 nt, Artificial Sequence
  Synthetic Oligonucleotide
cagacaucucuuuuuauugcaagaagu

SEQ ID NO: 3948 - RNA, 27 nt, Artificial Sequence
  Synthetic Oligonucleotide
agucagagaugccgcauuugaagcauu

SEQ ID NO: 3949 - RNA, 27 nt, Artificial Sequence
  Synthetic Oligonucleotide
agcauuggguacugcuuugaagguggu

SEQ ID NO: 3950 - RNA, 27 nt, Artificial Sequence
  Synthetic Oligonucleotide
auguggacaaacucaagcuugauaaga

SEQ ID NO: 3951 - RNA, 27 nt, Artificial Sequence
  Synthetic Oligonucleotide
caaagaauguucagaaaagguagaacu

SEQ ID NO: 3952 - RNA, 27 nt, Artificial Sequence
  Synthetic Oligonucleotide
guucagaaaagguagaacugauacaug

SEQ ID NO: 3953 - RNA, 27 nt, Artificial Sequence
  Synthetic Oligonucleotide
aagguagaacugauacaugguaagaaa

SEQ ID NO: 3954 - RNA, 27 nt, Artificial Sequence
  Synthetic Oligonucleotide
cgcagggaauacuggaaccaagaacaa

SEQ ID NO: 3955 - RNA, 27 nt, Artificial Sequence
  Synthetic Oligonucleotide
agccugagcucucgauagaaguaugug

SEQ ID NO: 3956 - RNA, 27 nt, Artificial Sequence
  Synthetic Oligonucleotide
cucgauagaaguaugugaagaaaaagc

SEQ ID NO: 3957 - RNA, 27 nt, Artificial Sequence
  Synthetic Oligonucleotide
uucuugacagcaguaacuggaaagaaa

SEQ ID NO: 3958 - RNA, 27 nt, Artificial Sequence
  Synthetic Oligonucleotide
gagcuaauggaccgaacugaaaugcca

SEQ ID NO: 3959 - RNA, 27 nt, Artificial Sequence
  Synthetic Oligonucleotide
cauuagugaggaugcuagccaagaaac

SEQ ID NO: 3960 - RNA, 27 nt, Artificial Sequence
  Synthetic Oligonucleotide
uagccaagaaaccuggauggaaagaaa

SEQ ID NO: 3961 - RNA, 27 nt, Artificial Sequence
  Synthetic Oligonucleotide
aagaaaccuggauggaaagaaacuaau

SEQ ID NO: 3962 - RNA, 27 nt, Artificial Sequence
  Synthetic Oligonucleotide
aggugaugcaaaugaagcuucauauag

SEQ ID NO: 3963 - RNA, 27 nt, Artificial Sequence
  Synthetic Oligonucleotide
caaaacgucagcucagguuguauuaga

SEQ ID NO: 3964 - RNA, 27 nt, Artificial Sequence
  Synthetic Oligonucleotide
ugcaaaagaagcuaugacagcaauagc

SEQ ID NO: 3965 - RNA, 27 nt, Artificial Sequence
  Synthetic Oligonucleotide
gacagcaauagccgaagccuguauguu

SEQ ID NO: 3966 - RNA, 27 nt, Artificial Sequence
  Synthetic Oligonucleotide
ccgaagccuguauguuaccauggacug

SEQ ID NO: 3967 - RNA, 27 nt, Artificial Sequence
  Synthetic Oligonucleotide
caaaaaucagucagaaacucugaauug

SEQ ID NO: 3968 - RNA, 27 nt, Artificial Sequence
  Synthetic Oligonucleotide
aaagcuuucauuagcaaugugaagaca

SEQ ID NO: 3969 - RNA, 27 nt, Artificial Sequence
  Synthetic Oligonucleotide
uugagaagaugcagggacaaaguccac

SEQ ID NO: 3970 - RNA, 27 nt, Artificial Sequence
  Synthetic Oligonucleotide
gagcaaugaugucguugaucuuuugcc

SEQ ID NO: 3971 - RNA, 27 nt, Artificial Sequence
  Synthetic Oligonucleotide
augaaguggcagguauuauuaaugacg

SEQ ID NO: 3972 - RNA, 27 nt, Artificial Sequence
  Synthetic Oligonucleotide
cugccuugaagggucgacucaaugauu

SEQ ID NO: 3973 - RNA, 27 nt, Artificial Sequence
  Synthetic Oligonucleotide
uugaagggucgacucaaugauucaaau

SEQ ID NO: 3974 - RNA, 27 nt, Artificial Sequence
  Synthetic Oligonucleotide
ucgacucaaugauucaaauaaaaucuu

SEQ ID NO: 3975 - RNA, 27 nt, Artificial Sequence
  Synthetic Oligonucleotide
caaugauucaaauaaaaucuugguaca

SEQ ID NO: 3976 - RNA, 27 nt, Artificial Sequence
  Synthetic Oligonucleotide
guagccaugggcccaaauauuaagcaa

SEQ ID NO: 3977 - RNA, 27 nt, Artificial Sequence
  Synthetic Oligonucleotide
ccaaauauuaagcaacauguaaaaaau

SEQ ID NO: 3978 - RNA, 27 nt, Artificial Sequence
  Synthetic Oligonucleotide
guccuuggagacagcaagaacaauguu

SEQ ID NO: 3979 - RNA, 27 nt, Artificial Sequence
  Synthetic Oligonucleotide
uggagacagcaagaacaauguucgagc

SEQ ID NO: 3980 - RNA, 27 nt, Artificial Sequence
  Synthetic Oligonucleotide
uucaugaugcauuuaggauaugaaaaa

SEQ ID NO: 3981 - RNA, 27 nt, Artificial Sequence
  Synthetic Oligonucleotide
ugcuagagaaagccaaaguuaacaugc

SEQ ID NO: 3982 - RNA, 27 nt, Artificial Sequence
  Synthetic Oligonucleotide
aagggaagaagaugccaagcaaaacca

SEQ ID NO: 3983 - RNA, 27 nt, Artificial Sequence
  Synthetic Oligonucleotide
uggaaaagagcaaaggaugaaagauga

SEQ ID NO: 3984 - RNA, 27 nt, Artificial Sequence
  Synthetic Oligonucleotide
aagagcaaaggaugaaagaugaaaaag

SEQ ID NO: 3985 - RNA, 27 nt, Artificial Sequence
  Synthetic Oligonucleotide
acgggaugaauacauugagcaacuaaa

SEQ ID NO: 3986 - RNA, 27 nt, Artificial Sequence
  Synthetic Oligonucleotide
augaauacauugagcaacuaaagacuc

SEQ ID NO: 3987 - RNA, 27 nt, Artificial Sequence
  Synthetic Oligonucleotide
aaaguggcuuacccugagguuuuuuga

SEQ ID NO: 3988 - RNA, 27 nt, Artificial Sequence
  Synthetic Oligonucleotide
acccugagguuuuuugacaccaauaca

SEQ ID NO: 3989 - RNA, 27 nt, Artificial Sequence
  Synthetic Oligonucleotide
accaauacaagcguccugaugaaagca

SEQ ID NO: 3990 - RNA, 27 nt, Artificial Sequence
  Synthetic Oligonucleotide
gcguccugaugaaagcacuagaauauu

SEQ ID NO: 3991 - RNA, 27 nt, Artificial Sequence
  Synthetic Oligonucleotide
ugaugaaagcacuagaauauuuaaaau

SEQ ID NO: 3992 - RNA, 27 nt, Artificial Sequence
  Synthetic Oligonucleotide
uggaaaucuuucugaaaaggauaugag

SEQ ID NO: 3993 - RNA, 27 nt, Artificial Sequence
  Synthetic Oligonucleotide
cugaaaaggauaugagcaugcucgagg

SEQ ID NO: 3994 - RNA, 27 nt, Artificial Sequence
  Synthetic Oligonucleotide
aagcuccaaugccaacauguuacgcaa

SEQ ID NO: 3995 - RNA, 27 nt, Artificial Sequence
  Synthetic Oligonucleotide
ccaaugccaacauguuacgcaagggac

SEQ ID NO: 3996 - RNA, 27 nt, Artificial Sequence
  Synthetic Oligonucleotide
augugaaaugccagaacuuguucagca

SEQ ID NO: 3997 - RNA, 27 nt, Artificial Sequence
  Synthetic Oligonucleotide
gccagaacuuguucagcacaaacugga

SEQ ID NO: 3998 - RNA, 27 nt, Artificial Sequence
  Synthetic Oligonucleotide
gcacaaacuggaugacauuuuugagcc

SEQ ID NO: 3999 - RNA, 27 nt, Artificial Sequence
  Synthetic Oligonucleotide
uggaugacauuuuugagccaguccuua

SEQ ID NO: 4000 - RNA, 27 nt, Artificial Sequence
  Synthetic Oligonucleotide
gacauuuuugagccaguccuuauuccu

SEQ ID NO: 4001 - RNA, 27 nt, Artificial Sequence
  Synthetic Oligonucleotide
uugagccaguccuuauuccugaaccca

SEQ ID NO: 4002 - RNA, 27 nt, Artificial Sequence
  Synthetic Oligonucleotide
cacuggaguacuaaaagaccuaaugca

SEQ ID NO: 4003 - RNA, 27 nt, Artificial Sequence
  Synthetic Oligonucleotide
uggugaagguucuggagaagucagacc

SEQ ID NO: 4004 - RNA, 27 nt, Artificial Sequence
  Synthetic Oligonucleotide
auccugagugcccuacuuguuuugcuc

SEQ ID NO: 4005 - RNA, 27 nt, Artificial Sequence
  Synthetic Oligonucleotide
aacagccaguucucccaaauucucaga

SEQ ID NO: 4006 - RNA, 27 nt, Artificial Sequence
  Synthetic Oligonucleotide
gagcuuguuaugaagugucucuggaga

SEQ ID NO: 4007 - RNA, 27 nt, Artificial Sequence
  Synthetic Oligonucleotide
uucgacuguugccugauaccaucaaua

SEQ ID NO: 4008 - RNA, 27 nt, Artificial Sequence
  Synthetic Oligonucleotide
cuguugccugauaccaucaauagcauu

SEQ ID NO: 4009 - RNA, 27 nt, Artificial Sequence
  Synthetic Oligonucleotide
gccugauaccaucaauagcauuaaccu

SEQ ID NO: 4010 - RNA, 27 nt, Artificial Sequence
  Synthetic Oligonucleotide
ccaucaauagcauuaaccuagacagaa

SEQ ID NO: 4011 - RNA, 27 nt, Artificial Sequence
  Synthetic Oligonucleotide
aauagcauuaaccuagacagaauucuu

SEQ ID NO: 4012 - RNA, 27 nt, Artificial Sequence
  Synthetic Oligonucleotide
cagaauucuucuggauauccacauuuu

SEQ ID NO: 4013 - RNA, 27 nt, Artificial Sequence
  Synthetic Oligonucleotide
uucuggauauccacauuuucaugaagg

SEQ ID NO: 4014 - RNA, 27 nt, Artificial Sequence
  Synthetic Oligonucleotide
ccaaagagaaacugaagcaaugcaaaa

SEQ ID NO: 4015 - RNA, 27 nt, Artificial Sequence
  Synthetic Oligonucleotide
gagaaacugaagcaaugcaaaagugaa

SEQ ID NO: 4016 - RNA, 27 nt, Artificial Sequence
  Synthetic Oligonucleotide
gccggaugaugaagcacaguauggacc

SEQ ID NO: 4017 - RNA, 27 nt, Artificial Sequence
  Synthetic Oligonucleotide
aacagaaaagggagcaucucgaauaga

SEQ ID NO: 4018 - RNA, 27 nt, Artificial Sequence
  Synthetic Oligonucleotide
aaagggagcaucucgaauagaugaaaa

SEQ ID NO: 4019 - RNA, 27 nt, Artificial Sequence
  Synthetic Oligonucleotide
gagcaucucgaauagaugaaaaaucau

SEQ ID NO: 4020 - RNA, 27 nt, Artificial Sequence
  Synthetic Oligonucleotide
aagagggacuagcagaguuauaugaau

SEQ ID NO: 4021 - RNA, 27 nt, Artificial Sequence
  Synthetic Oligonucleotide
auacucagaugcugacauugaaccauu

SEQ ID NO: 4022 - RNA, 27 nt, Artificial Sequence
  Synthetic Oligonucleotide
agcauucagaccuggauucuaaccaga

SEQ ID NO: 4023 - RNA, 27 nt, Artificial Sequence
  Synthetic Oligonucleotide
cagaccuggauucuaaccagacucacu

SEQ ID NO: 4024 - RNA, 27 nt, Artificial Sequence
  Synthetic Oligonucleotide
cuggauucuaaccagacucacucuuca

SEQ ID NO: 4025 - RNA, 27 nt, Artificial Sequence
  Synthetic Oligonucleotide
cagcuaacauagacgacuugaaaaaaa

SEQ ID NO: 4026 - RNA, 27 nt, Artificial Sequence
  Synthetic Oligonucleotide
aacauagacgacuugaaaaaaagacug

SEQ ID NO: 4027 - RNA, 27 nt, Artificial Sequence
  Synthetic Oligonucleotide
aacuagaaguccucauaguuuaaaaug

SEQ ID NO: 4028 - RNA, 27 nt, Artificial Sequence
  Synthetic Oligonucleotide
uggaugaguuuaguguacagacuugua

SEQ ID NO: 4029 - RNA, 27 nt, Artificial Sequence
  Synthetic Oligonucleotide
cccagauccuuuucuuuucuuuuuaau

SEQ ID NO: 4030 - RNA, 27 nt, Artificial Sequence
  Synthetic Oligonucleotide
auugcucauuuguaaaauuguccuaau

SEQ ID NO: 4031 - RNA, 27 nt, Artificial Sequence
  Synthetic Oligonucleotide
cugaagggucacuguauucuguaugaa

SEQ ID NO: 4032 - RNA, 27 nt, Artificial Sequence
  Synthetic Oligonucleotide
gggucacuguauucuguaugaaugcau

SEQ ID NO: 4033 - RNA, 19 nt, Artificial Sequence
  Synthetic Oligonucleotide
gaagcacaaugggagauga

SEQ ID NO: 4034 - RNA, 19 nt, Artificial Sequence
  Synthetic Oligonucleotide
agcacaaugggagaugaca

SEQ ID NO: 4035 - RNA, 19 nt, Artificial Sequence
  Synthetic Oligonucleotide
cacaaugggagaugacagu

SEQ ID NO: 4036 - RNA, 19 nt, Artificial Sequence
  Synthetic Oligonucleotide
caaugggagaugacaguga

SEQ ID NO: 4037 - RNA, 19 nt, Artificial Sequence
  Synthetic Oligonucleotide
augggagaugacagugagu

SEQ ID NO: 4038 - RNA, 19 nt, Artificial Sequence
  Synthetic Oligonucleotide
gggagaugacagugagugg

SEQ ID NO: 4039 - RNA, 19 nt, Artificial Sequence
  Synthetic Oligonucleotide
gagaugacagugagugguu

SEQ ID NO: 4040 - RNA, 19 nt, Artificial Sequence
  Synthetic Oligonucleotide
gaugacagugagugguuga

SEQ ID NO: 4041 - RNA, 19 nt, Artificial Sequence
  Synthetic Oligonucleotide
ugacagugagugguugaaa

SEQ ID NO: 4042 - RNA, 19 nt, Artificial Sequence
  Synthetic Oligonucleotide
gaagaucuuccagaaaaua

SEQ ID NO: 4043 - RNA, 19 nt, Artificial Sequence
  Synthetic Oligonucleotide
agaucuuccagaaaauaaa

SEQ ID NO: 4044 - RNA, 19 nt, Artificial Sequence
  Synthetic Oligonucleotide
aucuuccagaaaauaaagg

SEQ ID NO: 4045 - RNA, 19 nt, Artificial Sequence
  Synthetic Oligonucleotide
cuuccagaaaauaaaggau

SEQ ID NO: 4046 - RNA, 19 nt, Artificial Sequence
  Synthetic Oligonucleotide
uccagaaaauaaaggauga

SEQ ID NO: 4047 - RNA, 19 nt, Artificial Sequence
  Synthetic Oligonucleotide
cagaaaauaaaggaugaaa

SEQ ID NO: 4048 - RNA, 19 nt, Artificial Sequence
  Synthetic Oligonucleotide
gaaaauaaaggaugaaaag

SEQ ID NO: 4049 - RNA, 19 nt, Artificial Sequence
  Synthetic Oligonucleotide
aaauaaaggaugaaaagag

SEQ ID NO: 4050 - RNA, 19 nt, Artificial Sequence
  Synthetic Oligonucleotide
ucaaaaaauuugucacuga

SEQ ID NO: 4051 - RNA, 19 nt, Artificial Sequence
  Synthetic Oligonucleotide
aaaaaauuugucacugauu

SEQ ID NO: 4052 - RNA, 19 nt, Artificial Sequence
  Synthetic Oligonucleotide
aaaauuugucacugauucc

SEQ ID NO: 4053 - RNA, 19 nt, Artificial Sequence
  Synthetic Oligonucleotide
aauuugucacugauuccaa

SEQ ID NO: 4054 - RNA, 19 nt, Artificial Sequence
  Synthetic Oligonucleotide
uuugucacugauuccaaug

SEQ ID NO: 4055 - RNA, 19 nt, Artificial Sequence
  Synthetic Oligonucleotide
ugucacugauuccaaugca

SEQ ID NO: 4056 - RNA, 19 nt, Artificial Sequence
  Synthetic Oligonucleotide
ucacugauuccaaugcagu

SEQ ID NO: 4057 - RNA, 19 nt, Artificial Sequence
  Synthetic Oligonucleotide
acugauuccaaugcagugg

SEQ ID NO: 4058 - RNA, 19 nt, Artificial Sequence
  Synthetic Oligonucleotide
ugauuccaaugcagugguu

SEQ ID NO: 4059 - RNA, 19 nt, Artificial Sequence
  Synthetic Oligonucleotide
auuccaaugcagugguuca

SEQ ID NO: 4060 - RNA, 19 nt, Artificial Sequence
  Synthetic Oligonucleotide
uccaaugcagugguucaau

SEQ ID NO: 4061 - RNA, 19 nt, Artificial Sequence
  Synthetic Oligonucleotide
caaugcagugguucaauug

SEQ ID NO: 4062 - RNA, 19 nt, Artificial Sequence
  Synthetic Oligonucleotide
augcagugguucaauugaa

SEQ ID NO: 4063 - RNA, 19 nt, Artificial Sequence
  Synthetic Oligonucleotide
gcagugguucaauugaaag

SEQ ID NO: 4064 - RNA, 19 nt, Artificial Sequence
  Synthetic Oligonucleotide
agugguucaauugaaagga

SEQ ID NO: 4065 - RNA, 19 nt, Artificial Sequence
  Synthetic Oligonucleotide
aagaucauaguggccugua

SEQ ID NO: 4066 - RNA, 19 nt, Artificial Sequence
  Synthetic Oligonucleotide
gaucauaguggccuguaua

SEQ ID NO: 4067 - RNA, 19 nt, Artificial Sequence
  Synthetic Oligonucleotide
ucauaguggccuguauaga

SEQ ID NO: 4068 - RNA, 19 nt, Artificial Sequence
  Synthetic Oligonucleotide
cacugaggaaagccuuaag

SEQ ID NO: 4069 - RNA, 19 nt, Artificial Sequence
  Synthetic Oligonucleotide
cugaggaaagccuuaagug

SEQ ID NO: 4070 - RNA, 19 nt, Artificial Sequence
  Synthetic Oligonucleotide
gaggaaagccuuaagugaa

SEQ ID NO: 4071 - RNA, 19 nt, Artificial Sequence
  Synthetic Oligonucleotide
ggaaagccuuaagugaauu

SEQ ID NO: 4072 - RNA, 19 nt, Artificial Sequence
  Synthetic Oligonucleotide
aaagccuuaagugaauuug

SEQ ID NO: 4073 - RNA, 19 nt, Artificial Sequence
  Synthetic Oligonucleotide
agccuuaagugaauuuggu

SEQ ID NO: 4074 - RNA, 19 nt, Artificial Sequence
  Synthetic Oligonucleotide
ccuuaagugaauuugguuc

SEQ ID NO: 4075 - RNA, 19 nt, Artificial Sequence
  Synthetic Oligonucleotide
uuaagugaauuugguucca

SEQ ID NO: 4076 - RNA, 19 nt, Artificial Sequence
  Synthetic Oligonucleotide
aagugaauuugguuccaaa

SEQ ID NO: 4077 - RNA, 19 nt, Artificial Sequence
  Synthetic Oligonucleotide
gugaauuugguuccaaaau

SEQ ID NO: 4078 - RNA, 19 nt, Artificial Sequence
  Synthetic Oligonucleotide
gaauuugguuccaaaauca

SEQ ID NO: 4079 - RNA, 19 nt, Artificial Sequence
  Synthetic Oligonucleotide
auuugguuccaaaaucauc

SEQ ID NO: 4080 - RNA, 19 nt, Artificial Sequence
  Synthetic Oligonucleotide
cguucccaacaagaacuag

SEQ ID NO: 4081 - RNA, 19 nt, Artificial Sequence
  Synthetic Oligonucleotide
uucccaacaagaacuagaa

SEQ ID NO: 4082 - RNA, 19 nt, Artificial Sequence
  Synthetic Oligonucleotide
cccaacaagaacuagaagc

SEQ ID NO: 4083 - RNA, 19 nt, Artificial Sequence
  Synthetic Oligonucleotide
caacaagaacuagaagcua

SEQ ID NO: 4084 - RNA, 19 nt, Artificial Sequence
  Synthetic Oligonucleotide
acaagaacuagaagcuaaa

SEQ ID NO: 4085 - RNA, 19 nt, Artificial Sequence
  Synthetic Oligonucleotide
aacagucugcugguggaga

SEQ ID NO: 4086 - RNA, 19 nt, Artificial Sequence
  Synthetic Oligonucleotide
cagucugcugguggagaug

SEQ ID NO: 4087 - RNA, 19 nt, Artificial Sequence
  Synthetic Oligonucleotide
guggugaugauggugauga

SEQ ID NO: 4088 - RNA, 19 nt, Artificial Sequence
  Synthetic Oligonucleotide
ggugaugauggugaugagg

SEQ ID NO: 4089 - RNA, 19 nt, Artificial Sequence
  Synthetic Oligonucleotide
auccuuuccaaacuuccca

SEQ ID NO: 4090 - RNA, 19 nt, Artificial Sequence
  Synthetic Oligonucleotide
ccuuuccaaacuucccaaa

SEQ ID NO: 4091 - RNA, 19 nt, Artificial Sequence
  Synthetic Oligonucleotide
uuuccaaacuucccaaaga

SEQ ID NO: 4092 - RNA, 19 nt, Artificial Sequence
  Synthetic Oligonucleotide
uccaaacuucccaaagacu

SEQ ID NO: 4093 - RNA, 19 nt, Artificial Sequence
  Synthetic Oligonucleotide
caaacuucccaaagacuuu

SEQ ID NO: 4094 - RNA, 19 nt, Artificial Sequence
  Synthetic Oligonucleotide
aacuucccaaagacuuuua

SEQ ID NO: 4095 - RNA, 19 nt, Artificial Sequence
  Synthetic Oligonucleotide
cuucccaaagacuuuuaug

SEQ ID NO: 4096 - RNA, 19 nt, Artificial Sequence
  Synthetic Oligonucleotide
ucccaaagacuuuuaugac

SEQ ID NO: 4097 - RNA, 19 nt, Artificial Sequence
  Synthetic Oligonucleotide
ccaaagacuuuuaugacaa

SEQ ID NO: 4098 - RNA, 19 nt, Artificial Sequence
  Synthetic Oligonucleotide
aaagacuuuuaugacaaaa

SEQ ID NO: 4099 - RNA, 19 nt, Artificial Sequence
  Synthetic Oligonucleotide
agacuuuuaugacaaaauu

SEQ ID NO: 4100 - RNA, 19 nt, Artificial Sequence
  Synthetic Oligonucleotide
acuuuuaugacaaaauuga

SEQ ID NO: 4101 - RNA, 19 nt, Artificial Sequence
  Synthetic Oligonucleotide
uuuuaugacaaaauugagg

SEQ ID NO: 4102 - RNA, 19 nt, Artificial Sequence
  Synthetic Oligonucleotide
uuaugacaaaauugaggca

SEQ ID NO: 4103 - RNA, 19 nt, Artificial Sequence
  Synthetic Oligonucleotide
augacaaaauugaggcaaa

SEQ ID NO: 4104 - RNA, 19 nt, Artificial Sequence
  Synthetic Oligonucleotide
aauggcaagagagaaaaga

SEQ ID NO: 4105 - RNA, 19 nt, Artificial Sequence
  Synthetic Oligonucleotide
agguuguuggaaaggacac

SEQ ID NO: 4106 - RNA, 19 nt, Artificial Sequence
  Synthetic Oligonucleotide
guuguuggaaaggacacca

SEQ ID NO: 4107 - RNA, 19 nt, Artificial Sequence
  Synthetic Oligonucleotide
uguuggaaaggacaccaau

SEQ ID NO: 4108 - RNA, 19 nt, Artificial Sequence
  Synthetic Oligonucleotide
uuggaaaggacaccaaugu

SEQ ID NO: 4109 - RNA, 19 nt, Artificial Sequence
  Synthetic Oligonucleotide
ggaaaggacaccaauguca

SEQ ID NO: 4110 - RNA, 19 nt, Artificial Sequence
  Synthetic Oligonucleotide
aaaggacaccaaugucaug

SEQ ID NO: 4111 - RNA, 19 nt, Artificial Sequence
  Synthetic Oligonucleotide
aggacaccaaugucauguu

SEQ ID NO: 4112 - RNA, 19 nt, Artificial Sequence
  Synthetic Oligonucleotide
gacaccaaugucauguugg

SEQ ID NO: 4113 - RNA, 19 nt, Artificial Sequence
  Synthetic Oligonucleotide
gcuuuggcagcaaaauguc

SEQ ID NO: 4114 - RNA, 19 nt, Artificial Sequence
  Synthetic Oligonucleotide
uuuggcagcaaaaugucuu

SEQ ID NO: 4115 - RNA, 19 nt, Artificial Sequence
  Synthetic Oligonucleotide
uggcagcaaaaugucuuac

SEQ ID NO: 4116 - RNA, 19 nt, Artificial Sequence
  Synthetic Oligonucleotide
gcagcaaaaugucuuacug

SEQ ID NO: 4117 - RNA, 19 nt, Artificial Sequence
  Synthetic Oligonucleotide
agcaaaaugucuuacuggc

SEQ ID NO: 4118 - RNA, 19 nt, Artificial Sequence
  Synthetic Oligonucleotide
agaaauuuggacaauaugc

SEQ ID NO: 4119 - RNA, 19 nt, Artificial Sequence
  Synthetic Oligonucleotide
aaauuuggacaauaugcag

SEQ ID NO: 4120 - RNA, 19 nt, Artificial Sequence
  Synthetic Oligonucleotide
auuuggacaauaugcagga

SEQ ID NO: 4121 - RNA, 19 nt, Artificial Sequence
  Synthetic Oligonucleotide
uuggacaauaugcaggaca

SEQ ID NO: 4122 - RNA, 19 nt, Artificial Sequence
  Synthetic Oligonucleotide
ggacaauaugcaggacaug

SEQ ID NO: 4123 - RNA, 19 nt, Artificial Sequence
  Synthetic Oligonucleotide
acaauaugcaggacauguu

SEQ ID NO: 4124 - RNA, 19 nt, Artificial Sequence
  Synthetic Oligonucleotide
aauaugcaggacauguugu

SEQ ID NO: 4125 - RNA, 19 nt, Artificial Sequence
  Synthetic Oligonucleotide
uaugcaggacauguugugc

SEQ ID NO: 4126 - RNA, 19 nt, Artificial Sequence
  Synthetic Oligonucleotide
ugcaggacauguugugcca

SEQ ID NO: 4127 - RNA, 19 nt, Artificial Sequence
  Synthetic Oligonucleotide
caggacauguugugccaac

SEQ ID NO: 4128 - RNA, 19 nt, Artificial Sequence
  Synthetic Oligonucleotide
cucaagugguacaagcccu

SEQ ID NO: 4129 - RNA, 19 nt, Artificial Sequence
  Synthetic Oligonucleotide
caagugguacaagcccugc

SEQ ID NO: 4130 - RNA, 19 nt, Artificial Sequence
  Synthetic Oligonucleotide
agugguacaagcccugcag

SEQ ID NO: 4131 - RNA, 19 nt, Artificial Sequence
  Synthetic Oligonucleotide
ugguacaagcccugcagga

SEQ ID NO: 4132 - RNA, 19 nt, Artificial Sequence
  Synthetic Oligonucleotide
guacaagcccugcaggagg

SEQ ID NO: 4133 - RNA, 19 nt, Artificial Sequence
  Synthetic Oligonucleotide
acaagcccugcaggaggca

SEQ ID NO: 4134 - RNA, 19 nt, Artificial Sequence
  Synthetic Oligonucleotide
aagcccugcaggaggcaau

SEQ ID NO: 4135 - RNA, 19 nt, Artificial Sequence
  Synthetic Oligonucleotide
gcccugcaggaggcaauug

SEQ ID NO: 4136 - RNA, 19 nt, Artificial Sequence
  Synthetic Oligonucleotide
ccugcaggaggcaauugau

SEQ ID NO: 4137 - RNA, 19 nt, Artificial Sequence
  Synthetic Oligonucleotide
ugcaggaggcaauugaugc

SEQ ID NO: 4138 - RNA, 19 nt, Artificial Sequence
  Synthetic Oligonucleotide
caggaggcaauugaugcaa

SEQ ID NO: 4139 - RNA, 19 nt, Artificial Sequence
  Synthetic Oligonucleotide
ggaggcaauugaugcaauc

SEQ ID NO: 4140 - RNA, 19 nt, Artificial Sequence
  Synthetic Oligonucleotide
aggcaauugaugcaaucuu

SEQ ID NO: 4141 - RNA, 19 nt, Artificial Sequence
  Synthetic Oligonucleotide
gcaauugaugcaaucuucc

SEQ ID NO: 4142 - RNA, 19 nt, Artificial Sequence
  Synthetic Oligonucleotide
acuaccacacuacagaaca

SEQ ID NO: 4143 - RNA, 19 nt, Artificial Sequence
  Synthetic Oligonucleotide
uaccacacuacagaacauc

SEQ ID NO: 4144 - RNA, 19 nt, Artificial Sequence
  Synthetic Oligonucleotide
ccacacuacagaacaucag

SEQ ID NO: 4145 - RNA, 19 nt, Artificial Sequence
  Synthetic Oligonucleotide
acacuacagaacaucagug

SEQ ID NO: 4146 - RNA, 19 nt, Artificial Sequence
  Synthetic Oligonucleotide
acuacagaacaucagugag

SEQ ID NO: 4147 - RNA, 19 nt, Artificial Sequence
  Synthetic Oligonucleotide
uacagaacaucagugagga

SEQ ID NO: 4148 - RNA, 19 nt, Artificial Sequence
  Synthetic Oligonucleotide
cagaacaucagugaggaug

SEQ ID NO: 4149 - RNA, 19 nt, Artificial Sequence
  Synthetic Oligonucleotide
uuagcaguaauggauaaua

SEQ ID NO: 4150 - RNA, 19 nt, Artificial Sequence
  Synthetic Oligonucleotide
agcaguaauggauaauaaa

SEQ ID NO: 4151 - RNA, 19 nt, Artificial Sequence
  Synthetic Oligonucleotide
caguaauggauaauaaaaa

SEQ ID NO: 4152 - RNA, 19 nt, Artificial Sequence
  Synthetic Oligonucleotide
guaauggauaauaaaaauc

SEQ ID NO: 4153 - RNA, 19 nt, Artificial Sequence
  Synthetic Oligonucleotide
accaucaagcagcagacau

SEQ ID NO: 4154 - RNA, 19 nt, Artificial Sequence
  Synthetic Oligonucleotide
cuacuuaagcacaucaaug

SEQ ID NO: 4155 - RNA, 19 nt, Artificial Sequence
  Synthetic Oligonucleotide
acuuaagcacaucaaugau

SEQ ID NO: 4156 - RNA, 19 nt, Artificial Sequence
  Synthetic Oligonucleotide
uuaagcacaucaaugauuc

SEQ ID NO: 4157 - RNA, 19 nt, Artificial Sequence
  Synthetic Oligonucleotide
aagcacaucaaugauucug

SEQ ID NO: 4158 - RNA, 19 nt, Artificial Sequence
  Synthetic Oligonucleotide
gcacaucaaugauucugcu

SEQ ID NO: 4159 - RNA, 19 nt, Artificial Sequence
  Synthetic Oligonucleotide
acaucaaugauucugcucc

SEQ ID NO: 4160 - RNA, 19 nt, Artificial Sequence
  Synthetic Oligonucleotide
aucaaugauucugcuccug

SEQ ID NO: 4161 - RNA, 19 nt, Artificial Sequence
  Synthetic Oligonucleotide
caaugauucugcuccugaa

SEQ ID NO: 4162 - RNA, 19 nt, Artificial Sequence
  Synthetic Oligonucleotide
augauucugcuccugaagu

SEQ ID NO: 4163 - RNA, 19 nt, Artificial Sequence
  Synthetic Oligonucleotide
gauucugcuccugaaguca

SEQ ID NO: 4164 - RNA, 19 nt, Artificial Sequence
  Synthetic Oligonucleotide
uucugcuccugaagucaga

SEQ ID NO: 4165 - RNA, 19 nt, Artificial Sequence
  Synthetic Oligonucleotide
cugcuccugaagucagaga

SEQ ID NO: 4166 - RNA, 19 nt, Artificial Sequence
  Synthetic Oligonucleotide
gcuccugaagucagagaug

SEQ ID NO: 4167 - RNA, 19 nt, Artificial Sequence
  Synthetic Oligonucleotide
gaucaaagaauguucagaa

SEQ ID NO: 4168 - RNA, 19 nt, Artificial Sequence
  Synthetic Oligonucleotide
ucaaagaauguucagaaaa

SEQ ID NO: 4169 - RNA, 19 nt, Artificial Sequence
  Synthetic Oligonucleotide
aaccuggauggaaagaaac

SEQ ID NO: 4170 - RNA, 19 nt, Artificial Sequence
  Synthetic Oligonucleotide
ccuggauggaaagaaacua

SEQ ID NO: 4171 - RNA, 19 nt, Artificial Sequence
  Synthetic Oligonucleotide
uggauggaaagaaacuaau

SEQ ID NO: 4172 - RNA, 19 nt, Artificial Sequence
  Synthetic Oligonucleotide
gauggaaagaaacuaauuu

SEQ ID NO: 4173 - RNA, 19 nt, Artificial Sequence
  Synthetic Oligonucleotide
uggaaagaaacuaauuuuc

SEQ ID NO: 4174 - RNA, 19 nt, Artificial Sequence
  Synthetic Oligonucleotide
gaaagaaacuaauuuucag

SEQ ID NO: 4175 - RNA, 19 nt, Artificial Sequence
  Synthetic Oligonucleotide
aagaaacuaauuuucaggu

SEQ ID NO: 4176 - RNA, 19 nt, Artificial Sequence
  Synthetic Oligonucleotide
gaaacuaauuuucagguga

SEQ ID NO: 4177 - RNA, 19 nt, Artificial Sequence
  Synthetic Oligonucleotide
aacuaauuuucaggugaug

SEQ ID NO: 4178 - RNA, 19 nt, Artificial Sequence
  Synthetic Oligonucleotide
cuaauuuucaggugaugca

SEQ ID NO: 4179 - RNA, 19 nt, Artificial Sequence
  Synthetic Oligonucleotide
uugcuuugauugcccagaa

SEQ ID NO: 4180 - RNA, 19 nt, Artificial Sequence
  Synthetic Oligonucleotide
gcuuugauugcccagaagg

SEQ ID NO: 4181 - RNA, 19 nt, Artificial Sequence
  Synthetic Oligonucleotide
uuugauugcccagaaggga

SEQ ID NO: 4182 - RNA, 19 nt, Artificial Sequence
  Synthetic Oligonucleotide
ugauugcccagaagggaaa

SEQ ID NO: 4183 - RNA, 19 nt, Artificial Sequence
  Synthetic Oligonucleotide
auugcccagaagggaaauu

SEQ ID NO: 4184 - RNA, 19 nt, Artificial Sequence
  Synthetic Oligonucleotide
ugcccagaagggaaauuuu

SEQ ID NO: 4185 - RNA, 19 nt, Artificial Sequence
  Synthetic Oligonucleotide
cccagaagggaaauuuuuc

SEQ ID NO: 4186 - RNA, 19 nt, Artificial Sequence
  Synthetic Oligonucleotide
gacaagauuggagauguga

SEQ ID NO: 4187 - RNA, 19 nt, Artificial Sequence
  Synthetic Oligonucleotide
caagauuggagaugugaaa

SEQ ID NO: 4188 - RNA, 19 nt, Artificial Sequence
  Synthetic Oligonucleotide
agauuggagaugugaaaug

SEQ ID NO: 4189 - RNA, 19 nt, Artificial Sequence
  Synthetic Oligonucleotide
auuggagaugugaaaugug

SEQ ID NO: 4190 - RNA, 19 nt, Artificial Sequence
  Synthetic Oligonucleotide
uggagaugugaaauguggg

SEQ ID NO: 4191 - RNA, 19 nt, Artificial Sequence
  Synthetic Oligonucleotide
gagaugugaaaugugggaa

SEQ ID NO: 4192 - RNA, 19 nt, Artificial Sequence
  Synthetic Oligonucleotide
gaugugaaaugugggaaca

SEQ ID NO: 4193 - RNA, 19 nt, Artificial Sequence
  Synthetic Oligonucleotide
ugugaaaugugggaacaau

SEQ ID NO: 4194 - RNA, 19 nt, Artificial Sequence
  Synthetic Oligonucleotide
ugaaaugugggaacaaugc

SEQ ID NO: 4195 - RNA, 19 nt, Artificial Sequence
  Synthetic Oligonucleotide
aaaugugggaacaaugcaa

SEQ ID NO: 4196 - RNA, 19 nt, Artificial Sequence
  Synthetic Oligonucleotide
augugggaacaaugcaaaa

SEQ ID NO: 4197 - RNA, 19 nt, Artificial Sequence
  Synthetic Oligonucleotide
gugggaacaaugcaaaaga

SEQ ID NO: 4198 - RNA, 19 nt, Artificial Sequence
  Synthetic Oligonucleotide
gggaacaaugcaaaagaag

SEQ ID NO: 4199 - RNA, 19 nt, Artificial Sequence
  Synthetic Oligonucleotide
guugaaugucaaagcuuuc

SEQ ID NO: 4200 - RNA, 19 nt, Artificial Sequence
  Synthetic Oligonucleotide
ugaaugucaaagcuuucau

SEQ ID NO: 4201 - RNA, 19 nt, Artificial Sequence
  Synthetic Oligonucleotide
aaugucaaagcuuucauua

SEQ ID NO: 4202 - RNA, 19 nt, Artificial Sequence
  Synthetic Oligonucleotide
ugucaaagcuuucauuagc

SEQ ID NO: 4203 - RNA, 19 nt, Artificial Sequence
  Synthetic Oligonucleotide
ucaaagcuuucauuagcaa

SEQ ID NO: 4204 - RNA, 19 nt, Artificial Sequence
  Synthetic Oligonucleotide
cccugcuuggcgugaugua

SEQ ID NO: 4205 - RNA, 19 nt, Artificial Sequence
  Synthetic Oligonucleotide
cugcuuggcgugauguauc

SEQ ID NO: 4206 - RNA, 19 nt, Artificial Sequence
  Synthetic Oligonucleotide
ucuuugaggaugagaagcc

SEQ ID NO: 4207 - RNA, 19 nt, Artificial Sequence
  Synthetic Oligonucleotide
uuugaggaugagaagccug

SEQ ID NO: 4208 - RNA, 19 nt, Artificial Sequence
  Synthetic Oligonucleotide
ugaggaugagaagccugcc

SEQ ID NO: 4209 - RNA, 19 nt, Artificial Sequence
  Synthetic Oligonucleotide
aggaugagaagccugcccu

SEQ ID NO: 4210 - RNA, 19 nt, Artificial Sequence
  Synthetic Oligonucleotide
gaugagaagccugcccucc

SEQ ID NO: 4211 - RNA, 19 nt, Artificial Sequence
  Synthetic Oligonucleotide
ugagaagccugcccuccua

SEQ ID NO: 4212 - RNA, 19 nt, Artificial Sequence
  Synthetic Oligonucleotide
agaagccugcccuccuauc

SEQ ID NO: 4213 - RNA, 19 nt, Artificial Sequence
  Synthetic Oligonucleotide
aagccugcccuccuauccc

SEQ ID NO: 4214 - RNA, 19 nt, Artificial Sequence
  Synthetic Oligonucleotide
gccugcccuccuaucccag

SEQ ID NO: 4215 - RNA, 19 nt, Artificial Sequence
  Synthetic Oligonucleotide
cugcccuccuaucccagau

SEQ ID NO: 4216 - RNA, 19 nt, Artificial Sequence
  Synthetic Oligonucleotide
gcccuccuaucccagauag

SEQ ID NO: 4217 - RNA, 19 nt, Artificial Sequence
  Synthetic Oligonucleotide
ccuccuaucccagauagau

SEQ ID NO: 4218 - RNA, 19 nt, Artificial Sequence
  Synthetic Oligonucleotide
uccuaucccagauagaugc

SEQ ID NO: 4219 - RNA, 19 nt, Artificial Sequence
  Synthetic Oligonucleotide
cuaucccagauagaugcag

SEQ ID NO: 4220 - RNA, 19 nt, Artificial Sequence
  Synthetic Oligonucleotide
aucccagauagaugcagaa

SEQ ID NO: 4221 - RNA, 19 nt, Artificial Sequence
  Synthetic Oligonucleotide
cccagauagaugcagaauu

SEQ ID NO: 4222 - RNA, 19 nt, Artificial Sequence
  Synthetic Oligonucleotide
aagaugcagggacaaaguc

SEQ ID NO: 4223 - RNA, 19 nt, Artificial Sequence
  Synthetic Oligonucleotide
uacagaugaaggagaagau

SEQ ID NO: 4224 - RNA, 19 nt, Artificial Sequence
  Synthetic Oligonucleotide
cagaugaaggagaagaugg

SEQ ID NO: 4225 - RNA, 19 nt, Artificial Sequence
  Synthetic Oligonucleotide
gaugaaggagaagauggag

SEQ ID NO: 4226 - RNA, 19 nt, Artificial Sequence
  Synthetic Oligonucleotide
guugaucuuuugccgagga

SEQ ID NO: 4227 - RNA, 19 nt, Artificial Sequence
  Synthetic Oligonucleotide
ggaaagaaggccuagauga

SEQ ID NO: 4228 - RNA, 19 nt, Artificial Sequence
  Synthetic Oligonucleotide
aaagaaggccuagaugaag

SEQ ID NO: 4229 - RNA, 19 nt, Artificial Sequence
  Synthetic Oligonucleotide
agaaggccuagaugaagug

SEQ ID NO: 4230 - RNA, 19 nt, Artificial Sequence
  Synthetic Oligonucleotide
aaggccuagaugaaguggc

SEQ ID NO: 4231 - RNA, 19 nt, Artificial Sequence
  Synthetic Oligonucleotide
ggccuagaugaaguggcag

SEQ ID NO: 4232 - RNA, 19 nt, Artificial Sequence
  Synthetic Oligonucleotide
ccuagaugaaguggcaggu

SEQ ID NO: 4233 - RNA, 19 nt, Artificial Sequence
  Synthetic Oligonucleotide
uagaugaaguggcagguau

SEQ ID NO: 4234 - RNA, 19 nt, Artificial Sequence
  Synthetic Oligonucleotide
gaugaaguggcagguauua

SEQ ID NO: 4235 - RNA, 19 nt, Artificial Sequence
  Synthetic Oligonucleotide
aauauaggugaacuuccaa

SEQ ID NO: 4236 - RNA, 19 nt, Artificial Sequence
  Synthetic Oligonucleotide
uauaggugaacuuccaacu

SEQ ID NO: 4237 - RNA, 19 nt, Artificial Sequence
  Synthetic Oligonucleotide
uaggugaacuuccaacugc

SEQ ID NO: 4238 - RNA, 19 nt, Artificial Sequence
  Synthetic Oligonucleotide
ggugaacuuccaacugccu

SEQ ID NO: 4239 - RNA, 19 nt, Artificial Sequence
  Synthetic Oligonucleotide
ugaacuuccaacugccuug

SEQ ID NO: 4240 - RNA, 19 nt, Artificial Sequence
  Synthetic Oligonucleotide
aacuuccaacugccuugaa

SEQ ID NO: 4241 - RNA, 19 nt, Artificial Sequence
  Synthetic Oligonucleotide
cuuccaacugccuugaagg

SEQ ID NO: 4242 - RNA, 19 nt, Artificial Sequence
  Synthetic Oligonucleotide
uccaacugccuugaagggu

SEQ ID NO: 4243 - RNA, 19 nt, Artificial Sequence
  Synthetic Oligonucleotide
caacugccuugaagggucg

SEQ ID NO: 4244 - RNA, 19 nt, Artificial Sequence
  Synthetic Oligonucleotide
acugccuugaagggucgac

SEQ ID NO: 4245 - RNA, 19 nt, Artificial Sequence
  Synthetic Oligonucleotide
caacuggcaguagccaugg

SEQ ID NO: 4246 - RNA, 19 nt, Artificial Sequence
  Synthetic Oligonucleotide
agcaagaacaauguucgag

SEQ ID NO: 4247 - RNA, 19 nt, Artificial Sequence
  Synthetic Oligonucleotide
caagaacaauguucgagcu

SEQ ID NO: 4248 - RNA, 19 nt, Artificial Sequence
  Synthetic Oligonucleotide
agaacaauguucgagcugc

SEQ ID NO: 4249 - RNA, 19 nt, Artificial Sequence
  Synthetic Oligonucleotide
aacaauguucgagcugcug

SEQ ID NO: 4250 - RNA, 19 nt, Artificial Sequence
  Synthetic Oligonucleotide
caauguucgagcugcugcc

SEQ ID NO: 4251 - RNA, 19 nt, Artificial Sequence
  Synthetic Oligonucleotide
auguucgagcugcugcccu

SEQ ID NO: 4252 - RNA, 19 nt, Artificial Sequence
  Synthetic Oligonucleotide
guucgagcugcugcccuag

SEQ ID NO: 4253 - RNA, 19 nt, Artificial Sequence
  Synthetic Oligonucleotide
acugugaaugcuugggcag

SEQ ID NO: 4254 - RNA, 19 nt, Artificial Sequence
  Synthetic Oligonucleotide
ugugaaugcuugggcagaa

SEQ ID NO: 4255 - RNA, 19 nt, Artificial Sequence
  Synthetic Oligonucleotide
ugaaugcuugggcagaaca

SEQ ID NO: 4256 - RNA, 19 nt, Artificial Sequence
  Synthetic Oligonucleotide
gagaagaucuuucugaaga

SEQ ID NO: 4257 - RNA, 19 nt, Artificial Sequence
  Synthetic Oligonucleotide
cuagaagaucgaaauggag

SEQ ID NO: 4258 - RNA, 19 nt, Artificial Sequence
  Synthetic Oligonucleotide
agaagaucgaaauggagau

SEQ ID NO: 4259 - RNA, 19 nt, Artificial Sequence
  Synthetic Oligonucleotide
aagaucgaaauggagaugu

SEQ ID NO: 4260 - RNA, 19 nt, Artificial Sequence
  Synthetic Oligonucleotide
ugaugcauuuaggauauga

SEQ ID NO: 4261 - RNA, 19 nt, Artificial Sequence
  Synthetic Oligonucleotide
augcauuuaggauaugaaa

SEQ ID NO: 4262 - RNA, 19 nt, Artificial Sequence
  Synthetic Oligonucleotide
gcauuuaggauaugaaaaa

SEQ ID NO: 4263 - RNA, 19 nt, Artificial Sequence
  Synthetic Oligonucleotide
auuuaggauaugaaaaaau

SEQ ID NO: 4264 - RNA, 19 nt, Artificial Sequence
  Synthetic Oligonucleotide
uuaggauaugaaaaaaugg

SEQ ID NO: 4265 - RNA, 19 nt, Artificial Sequence
  Synthetic Oligonucleotide
aaggcuacugggaaacuaa

SEQ ID NO: 4266 - RNA, 19 nt, Artificial Sequence
  Synthetic Oligonucleotide
ggcuacugggaaacuaaag

SEQ ID NO: 4267 - RNA, 19 nt, Artificial Sequence
  Synthetic Oligonucleotide
cuacugggaaacuaaagcc

SEQ ID NO: 4268 - RNA, 19 nt, Artificial Sequence
  Synthetic Oligonucleotide
acugggaaacuaaagccaa

SEQ ID NO: 4269 - RNA, 19 nt, Artificial Sequence
  Synthetic Oligonucleotide
ugggaaacuaaagccaacu

SEQ ID NO: 4270 - RNA, 19 nt, Artificial Sequence
  Synthetic Oligonucleotide
ggaaacuaaagccaacuuc

SEQ ID NO: 4271 - RNA, 19 nt, Artificial Sequence
  Synthetic Oligonucleotide
aaacuaaagccaacuucua

SEQ ID NO: 4272 - RNA, 19 nt, Artificial Sequence
  Synthetic Oligonucleotide
acuaaagccaacuucuaaa

SEQ ID NO: 4273 - RNA, 19 nt, Artificial Sequence
  Synthetic Oligonucleotide
uaaagccaacuucuaaaga

SEQ ID NO: 4274 - RNA, 19 nt, Artificial Sequence
  Synthetic Oligonucleotide
aagccaacuucuaaagauc

SEQ ID NO: 4275 - RNA, 19 nt, Artificial Sequence
  Synthetic Oligonucleotide
ccuauuuuuauuguuguuc

SEQ ID NO: 4276 - RNA, 19 nt, Artificial Sequence
  Synthetic Oligonucleotide
uauuuuuauuguuguucca

SEQ ID NO: 4277 - RNA, 19 nt, Artificial Sequence
  Synthetic Oligonucleotide
uuuuuauuguuguuccaaa

SEQ ID NO: 4278 - RNA, 19 nt, Artificial Sequence
  Synthetic Oligonucleotide
uuuauuguuguuccaaaug

SEQ ID NO: 4279 - RNA, 19 nt, Artificial Sequence
  Synthetic Oligonucleotide
uauuguuguuccaaaugga

SEQ ID NO: 4280 - RNA, 19 nt, Artificial Sequence
  Synthetic Oligonucleotide
uuguuguuccaaauggaaa

SEQ ID NO: 4281 - RNA, 19 nt, Artificial Sequence
  Synthetic Oligonucleotide
aggugcuaaaguggaauuu

SEQ ID NO: 4282 - RNA, 19 nt, Artificial Sequence
  Synthetic Oligonucleotide
gugcuaaaguggaauuuua

SEQ ID NO: 4283 - RNA, 19 nt, Artificial Sequence
  Synthetic Oligonucleotide
aucaucuuacugagaauga

SEQ ID NO: 4284 - RNA, 19 nt, Artificial Sequence
  Synthetic Oligonucleotide
caucuuacugagaaugaag

SEQ ID NO: 4285 - RNA, 19 nt, Artificial Sequence
  Synthetic Oligonucleotide
ucuuacugagaaugaagca

SEQ ID NO: 4286 - RNA, 19 nt, Artificial Sequence
  Synthetic Oligonucleotide
uuacugagaaugaagcauc

SEQ ID NO: 4287 - RNA, 19 nt, Artificial Sequence
  Synthetic Oligonucleotide
caagguuggagaaccaaag

SEQ ID NO: 4288 - RNA, 19 nt, Artificial Sequence
  Synthetic Oligonucleotide
agguuggagaaccaaagga

SEQ ID NO: 4289 - RNA, 19 nt, Artificial Sequence
  Synthetic Oligonucleotide
guuggagaaccaaaggaug

SEQ ID NO: 4290 - RNA, 19 nt, Artificial Sequence
  Synthetic Oligonucleotide
uggagaaccaaaggauguc

SEQ ID NO: 4291 - RNA, 19 nt, Artificial Sequence
  Synthetic Oligonucleotide
gagaaccaaaggaugucau

SEQ ID NO: 4292 - RNA, 19 nt, Artificial Sequence
  Synthetic Oligonucleotide
gaaccaaaggaugucauuc

SEQ ID NO: 4293 - RNA, 19 nt, Artificial Sequence
  Synthetic Oligonucleotide
accaaaggaugucauucgu

SEQ ID NO: 4294 - RNA, 19 nt, Artificial Sequence
  Synthetic Oligonucleotide
caaaggaugucauucguaa

SEQ ID NO: 4295 - RNA, 19 nt, Artificial Sequence
  Synthetic Oligonucleotide
aaggaugucauucguaaag

SEQ ID NO: 4296 - RNA, 19 nt, Artificial Sequence
  Synthetic Oligonucleotide
ggaugucauucguaaagau

SEQ ID NO: 4297 - RNA, 19 nt, Artificial Sequence
  Synthetic Oligonucleotide
augucauucguaaagaugu

SEQ ID NO: 4298 - RNA, 19 nt, Artificial Sequence
  Synthetic Oligonucleotide
uccugaaccggaugugccu

SEQ ID NO: 4299 - RNA, 19 nt, Artificial Sequence
  Synthetic Oligonucleotide
cugaaccggaugugccuug

SEQ ID NO: 4300 - RNA, 19 nt, Artificial Sequence
  Synthetic Oligonucleotide
gaaccggaugugccuuguc

SEQ ID NO: 4301 - RNA, 19 nt, Artificial Sequence
  Synthetic Oligonucleotide
accggaugugccuugucua

SEQ ID NO: 4302 - RNA, 19 nt, Artificial Sequence
  Synthetic Oligonucleotide
cggaugugccuugucuacc

SEQ ID NO: 4303 - RNA, 19 nt, Artificial Sequence
  Synthetic Oligonucleotide
gaugugccuugucuaccca

SEQ ID NO: 4304 - RNA, 19 nt, Artificial Sequence
  Synthetic Oligonucleotide
ugugccuugucuacccagc

SEQ ID NO: 4305 - RNA, 19 nt, Artificial Sequence
  Synthetic Oligonucleotide
ccaaaaacucuaagcagag

SEQ ID NO: 4306 - RNA, 19 nt, Artificial Sequence
  Synthetic Oligonucleotide
aaaaacucuaagcagagag

SEQ ID NO: 4307 - RNA, 19 nt, Artificial Sequence
  Synthetic Oligonucleotide
aaacucuaagcagagagca

SEQ ID NO: 4308 - RNA, 19 nt, Artificial Sequence
  Synthetic Oligonucleotide
acucuaagcagagagcaga

SEQ ID NO: 4309 - RNA, 19 nt, Artificial Sequence
  Synthetic Oligonucleotide
ucuaagcagagagcagagu

SEQ ID NO: 4310 - RNA, 19 nt, Artificial Sequence
  Synthetic Oligonucleotide
uaagcagagagcagagugc

SEQ ID NO: 4311 - RNA, 19 nt, Artificial Sequence
  Synthetic Oligonucleotide
agcagagagcagagugccu

SEQ ID NO: 4312 - RNA, 19 nt, Artificial Sequence
  Synthetic Oligonucleotide
cagagagcagagugccugg

SEQ ID NO: 4313 - RNA, 19 nt, Artificial Sequence
  Synthetic Oligonucleotide
gagagcagagugccuggaa

SEQ ID NO: 4314 - RNA, 19 nt, Artificial Sequence
  Synthetic Oligonucleotide
gagcagagugccuggaaga

SEQ ID NO: 4315 - RNA, 19 nt, Artificial Sequence
  Synthetic Oligonucleotide
gcagagugccuggaagagc

SEQ ID NO: 4316 - RNA, 19 nt, Artificial Sequence
  Synthetic Oligonucleotide
caggaaaagccuuaaagga

SEQ ID NO: 4317 - RNA, 19 nt, Artificial Sequence
  Synthetic Oligonucleotide
aucagguguucaaacugau

SEQ ID NO: 4318 - RNA, 19 nt, Artificial Sequence
  Synthetic Oligonucleotide
cagguguucaaacugauug

SEQ ID NO: 4319 - RNA, 19 nt, Artificial Sequence
  Synthetic Oligonucleotide
gguguucaaacugauugga

SEQ ID NO: 4320 - RNA, 19 nt, Artificial Sequence
  Synthetic Oligonucleotide
uguucaaacugauuggaaa

SEQ ID NO: 4321 - RNA, 19 nt, Artificial Sequence
  Synthetic Oligonucleotide
uucaaacugauuggaaauc

SEQ ID NO: 4322 - RNA, 19 nt, Artificial Sequence
  Synthetic Oligonucleotide
caaacugauuggaaaucuu

SEQ ID NO: 4323 - RNA, 19 nt, Artificial Sequence
  Synthetic Oligonucleotide
aacugauuggaaaucuuuc

SEQ ID NO: 4324 - RNA, 19 nt, Artificial Sequence
  Synthetic Oligonucleotide
cugauuggaaaucuuucug

SEQ ID NO: 4325 - RNA, 19 nt, Artificial Sequence
  Synthetic Oligonucleotide
aagcggucagcaaagagac

SEQ ID NO: 4326 - RNA, 19 nt, Artificial Sequence
  Synthetic Oligonucleotide
gcggucagcaaagagaccc

SEQ ID NO: 4327 - RNA, 19 nt, Artificial Sequence
  Synthetic Oligonucleotide
ggucagcaaagagacccuc

SEQ ID NO: 4328 - RNA, 19 nt, Artificial Sequence
  Synthetic Oligonucleotide
ucagcaaagagacccucug

SEQ ID NO: 4329 - RNA, 19 nt, Artificial Sequence
  Synthetic Oligonucleotide
agcaaagagacccucugcu

SEQ ID NO: 4330 - RNA, 19 nt, Artificial Sequence
  Synthetic Oligonucleotide
caaagagacccucugcugc

SEQ ID NO: 4331 - RNA, 19 nt, Artificial Sequence
  Synthetic Oligonucleotide
aagagacccucugcugcac

SEQ ID NO: 4332 - RNA, 19 nt, Artificial Sequence
  Synthetic Oligonucleotide
uacgcaagggaccagcuga

SEQ ID NO: 4333 - RNA, 19 nt, Artificial Sequence
  Synthetic Oligonucleotide
cgcaagggaccagcugagg

SEQ ID NO: 4334 - RNA, 19 nt, Artificial Sequence
  Synthetic Oligonucleotide
cgccgagaauuccagcugg

SEQ ID NO: 4335 - RNA, 19 nt, Artificial Sequence
  Synthetic Oligonucleotide
ccgagaauuccagcuggau

SEQ ID NO: 4336 - RNA, 19 nt, Artificial Sequence
  Synthetic Oligonucleotide
agauccgggcuguuucucc

SEQ ID NO: 4337 - RNA, 19 nt, Artificial Sequence
  Synthetic Oligonucleotide
auccgggcuguuucuccac

SEQ ID NO: 4338 - RNA, 19 nt, Artificial Sequence
  Synthetic Oligonucleotide
gaugacaugcacaguaaua

SEQ ID NO: 4339 - RNA, 19 nt, Artificial Sequence
  Synthetic Oligonucleotide
ugacaugcacaguaauaca

SEQ ID NO: 4340 - RNA, 19 nt, Artificial Sequence
  Synthetic Oligonucleotide
acaugcacaguaauacagc

SEQ ID NO: 4341 - RNA, 19 nt, Artificial Sequence
  Synthetic Oligonucleotide
augcacaguaauacagcau

SEQ ID NO: 4342 - RNA, 19 nt, Artificial Sequence
  Synthetic Oligonucleotide
gcacaguaauacagcaucc

SEQ ID NO: 4343 - RNA, 19 nt, Artificial Sequence
  Synthetic Oligonucleotide
acaguaauacagcauccac

SEQ ID NO: 4344 - RNA, 19 nt, Artificial Sequence
  Synthetic Oligonucleotide
aguaauacagcauccacaa

SEQ ID NO: 4345 - RNA, 19 nt, Artificial Sequence
  Synthetic Oligonucleotide
uaauacagcauccacaauc

SEQ ID NO: 4346 - RNA, 19 nt, Artificial Sequence
  Synthetic Oligonucleotide
auacagcauccacaaucaa

SEQ ID NO: 4347 - RNA, 19 nt, Artificial Sequence
  Synthetic Oligonucleotide
acagcauccacaaucaauu

SEQ ID NO: 4348 - RNA, 19 nt, Artificial Sequence
  Synthetic Oligonucleotide
agcauccacaaucaauuuc

SEQ ID NO: 4349 - RNA, 19 nt, Artificial Sequence
  Synthetic Oligonucleotide
cauccacaaucaauuucau

SEQ ID NO: 4350 - RNA, 19 nt, Artificial Sequence
  Synthetic Oligonucleotide
uccacaaucaauuucauua

SEQ ID NO: 4351 - RNA, 19 nt, Artificial Sequence
  Synthetic Oligonucleotide
cacaaucaauuucauuauc

SEQ ID NO: 4352 - RNA, 19 nt, Artificial Sequence
  Synthetic Oligonucleotide
caaucaauuucauuaucuc

SEQ ID NO: 4353 - RNA, 19 nt, Artificial Sequence
  Synthetic Oligonucleotide
aucaauuucauuaucuccc

SEQ ID NO: 4354 - RNA, 19 nt, Artificial Sequence
  Synthetic Oligonucleotide
caauuucauuaucucccaa

SEQ ID NO: 4355 - RNA, 19 nt, Artificial Sequence
  Synthetic Oligonucleotide
auuucauuaucucccaagu

SEQ ID NO: 4356 - RNA, 19 nt, Artificial Sequence
  Synthetic Oligonucleotide
uucauuaucucccaaguag

SEQ ID NO: 4357 - RNA, 19 nt, Artificial Sequence
  Synthetic Oligonucleotide
cauuaucucccaaguagcc

SEQ ID NO: 4358 - RNA, 19 nt, Artificial Sequence
  Synthetic Oligonucleotide
uuaucucccaaguagccag

SEQ ID NO: 4359 - RNA, 19 nt, Artificial Sequence
  Synthetic Oligonucleotide
aucucccaaguagccagug

SEQ ID NO: 4360 - RNA, 19 nt, Artificial Sequence
  Synthetic Oligonucleotide
cucccaaguagccaguggu

SEQ ID NO: 4361 - RNA, 19 nt, Artificial Sequence
  Synthetic Oligonucleotide
cccaaguagccagugguga

SEQ ID NO: 4362 - RNA, 19 nt, Artificial Sequence
  Synthetic Oligonucleotide
caaguagccaguggugaca

SEQ ID NO: 4363 - RNA, 19 nt, Artificial Sequence
  Synthetic Oligonucleotide
gcccgggaggccuccacug

SEQ ID NO: 4364 - RNA, 19 nt, Artificial Sequence
  Synthetic Oligonucleotide
ccgggaggccuccacugga

SEQ ID NO: 4365 - RNA, 19 nt, Artificial Sequence
  Synthetic Oligonucleotide
gggaggccuccacuggagu

SEQ ID NO: 4366 - RNA, 19 nt, Artificial Sequence
  Synthetic Oligonucleotide
gaggccuccacuggaguac

SEQ ID NO: 4367 - RNA, 19 nt, Artificial Sequence
  Synthetic Oligonucleotide
aucaccuuaaugcuggauu

SEQ ID NO: 4368 - RNA, 19 nt, Artificial Sequence
  Synthetic Oligonucleotide
caccuuaaugcuggauucu

SEQ ID NO: 4369 - RNA, 19 nt, Artificial Sequence
  Synthetic Oligonucleotide
ccuuaaugcuggauucucg

SEQ ID NO: 4370 - RNA, 19 nt, Artificial Sequence
  Synthetic Oligonucleotide
uuaaugcuggauucucgga

SEQ ID NO: 4371 - RNA, 19 nt, Artificial Sequence
  Synthetic Oligonucleotide
aaugcuggauucucggauu

SEQ ID NO: 4372 - RNA, 19 nt, Artificial Sequence
  Synthetic Oligonucleotide
ugcuggauucucggauuga

SEQ ID NO: 4373 - RNA, 19 nt, Artificial Sequence
  Synthetic Oligonucleotide
cuggauucucggauugaag

SEQ ID NO: 4374 - RNA, 19 nt, Artificial Sequence
  Synthetic Oligonucleotide
ggauucucggauugaagau

SEQ ID NO: 4375 - RNA, 19 nt, Artificial Sequence
  Synthetic Oligonucleotide
auucucggauugaagaucu

SEQ ID NO: 4376 - RNA, 19 nt, Artificial Sequence
  Synthetic Oligonucleotide
cugugaaccucuugguggu

SEQ ID NO: 4377 - RNA, 19 nt, Artificial Sequence
  Synthetic Oligonucleotide
gugaaccucuuggugguga

SEQ ID NO: 4378 - RNA, 19 nt, Artificial Sequence
  Synthetic Oligonucleotide
gaaccucuugguggugaag

SEQ ID NO: 4379 - RNA, 19 nt, Artificial Sequence
  Synthetic Oligonucleotide
accucuugguggugaaggu

SEQ ID NO: 4380 - RNA, 19 nt, Artificial Sequence
  Synthetic Oligonucleotide
gacagccugcuagcaacag

SEQ ID NO: 4381 - RNA, 19 nt, Artificial Sequence
  Synthetic Oligonucleotide
aguucucccaaauucucag

SEQ ID NO: 4382 - RNA, 19 nt, Artificial Sequence
  Synthetic Oligonucleotide
uucucccaaauucucagag

SEQ ID NO: 4383 - RNA, 19 nt, Artificial Sequence
  Synthetic Oligonucleotide
cucccaaauucucagagcu

SEQ ID NO: 4384 - RNA, 19 nt, Artificial Sequence
  Synthetic Oligonucleotide
cccaaauucucagagcuug

SEQ ID NO: 4385 - RNA, 19 nt, Artificial Sequence
  Synthetic Oligonucleotide
caaauucucagagcuuguu

SEQ ID NO: 4386 - RNA, 19 nt, Artificial Sequence
  Synthetic Oligonucleotide
aauucucagagcuuguuau

SEQ ID NO: 4387 - RNA, 19 nt, Artificial Sequence
  Synthetic Oligonucleotide
uucucagagcuuguuauga

SEQ ID NO: 4388 - RNA, 19 nt, Artificial Sequence
  Synthetic Oligonucleotide
cucagagcuuguuaugaag

SEQ ID NO: 4389 - RNA, 19 nt, Artificial Sequence
  Synthetic Oligonucleotide
cagagcuuguuaugaagug

SEQ ID NO: 4390 - RNA, 19 nt, Artificial Sequence
  Synthetic Oligonucleotide
gagcuuguuaugaaguguc

SEQ ID NO: 4391 - RNA, 19 nt, Artificial Sequence
  Synthetic Oligonucleotide
agcauuaaccuagacagaa

SEQ ID NO: 4392 - RNA, 19 nt, Artificial Sequence
  Synthetic Oligonucleotide
cauuaaccuagacagaauu

SEQ ID NO: 4393 - RNA, 19 nt, Artificial Sequence
  Synthetic Oligonucleotide
uuaaccuagacagaauucu

SEQ ID NO: 4394 - RNA, 19 nt, Artificial Sequence
  Synthetic Oligonucleotide
aaccuagacagaauucuuc

SEQ ID NO: 4395 - RNA, 19 nt, Artificial Sequence
  Synthetic Oligonucleotide
ccuagacagaauucuucug

SEQ ID NO: 4396 - RNA, 19 nt, Artificial Sequence
  Synthetic Oligonucleotide
uagacagaauucuucugga

SEQ ID NO: 4397 - RNA, 19 nt, Artificial Sequence
  Synthetic Oligonucleotide
uccacauuuucaugaaggu

SEQ ID NO: 4398 - RNA, 19 nt, Artificial Sequence
  Synthetic Oligonucleotide
gaagcaaugcaaaagugaa

SEQ ID NO: 4399 - RNA, 19 nt, Artificial Sequence
  Synthetic Oligonucleotide
agcaaugcaaaagugaauu

SEQ ID NO: 4400 - RNA, 19 nt, Artificial Sequence
  Synthetic Oligonucleotide
caaugcaaaagugaauuuc

SEQ ID NO: 4401 - RNA, 19 nt, Artificial Sequence
  Synthetic Oligonucleotide
aguauggaccagacuggga

SEQ ID NO: 4402 - RNA, 19 nt, Artificial Sequence
  Synthetic Oligonucleotide
uauggaccagacugggagc

SEQ ID NO: 4403 - RNA, 19 nt, Artificial Sequence
  Synthetic Oligonucleotide
uggaccagacugggagcaa

SEQ ID NO: 4404 - RNA, 19 nt, Artificial Sequence
  Synthetic Oligonucleotide
gaccagacugggagcaagu

SEQ ID NO: 4405 - RNA, 19 nt, Artificial Sequence
  Synthetic Oligonucleotide
ccagacugggagcaagucu

SEQ ID NO: 4406 - RNA, 19 nt, Artificial Sequence
  Synthetic Oligonucleotide
agacugggagcaagucuga

SEQ ID NO: 4407 - RNA, 19 nt, Artificial Sequence
  Synthetic Oligonucleotide
acugggagcaagucugaua

SEQ ID NO: 4408 - RNA, 19 nt, Artificial Sequence
  Synthetic Oligonucleotide
ugggagcaagucugauaag

SEQ ID NO: 4409 - RNA, 19 nt, Artificial Sequence
  Synthetic Oligonucleotide
ggagcaagucugauaagga

SEQ ID NO: 4410 - RNA, 19 nt, Artificial Sequence
  Synthetic Oligonucleotide
agcaagucugauaaggaaa

SEQ ID NO: 4411 - RNA, 19 nt, Artificial Sequence
  Synthetic Oligonucleotide
caagucugauaaggaaaca

SEQ ID NO: 4412 - RNA, 19 nt, Artificial Sequence
  Synthetic Oligonucleotide
agucugauaaggaaacaga

SEQ ID NO: 4413 - RNA, 19 nt, Artificial Sequence
  Synthetic Oligonucleotide
ucugauaaggaaacagaaa

SEQ ID NO: 4414 - RNA, 19 nt, Artificial Sequence
  Synthetic Oligonucleotide
ugauaaggaaacagaaaag

SEQ ID NO: 4415 - RNA, 19 nt, Artificial Sequence
  Synthetic Oligonucleotide
auaaggaaacagaaaaggg

SEQ ID NO: 4416 - RNA, 19 nt, Artificial Sequence
  Synthetic Oligonucleotide
aaggaaacagaaaagggag

SEQ ID NO: 4417 - RNA, 19 nt, Artificial Sequence
  Synthetic Oligonucleotide
ucucgaauagaugaaaaau

SEQ ID NO: 4418 - RNA, 19 nt, Artificial Sequence
  Synthetic Oligonucleotide
ucgaauagaugaaaaauca

SEQ ID NO: 4419 - RNA, 19 nt, Artificial Sequence
  Synthetic Oligonucleotide
gaauagaugaaaaaucauc

SEQ ID NO: 4420 - RNA, 19 nt, Artificial Sequence
  Synthetic Oligonucleotide
auagaugaaaaaucaucaa

SEQ ID NO: 4421 - RNA, 19 nt, Artificial Sequence
  Synthetic Oligonucleotide
agaugaaaaaucaucaaag

SEQ ID NO: 4422 - RNA, 19 nt, Artificial Sequence
  Synthetic Oligonucleotide
augaaaaaucaucaaaggc

SEQ ID NO: 4423 - RNA, 19 nt, Artificial Sequence
  Synthetic Oligonucleotide
gaaaaaucaucaaaggcca

SEQ ID NO: 4424 - RNA, 19 nt, Artificial Sequence
  Synthetic Oligonucleotide
aaaaucaucaaaggccaaa

SEQ ID NO: 4425 - RNA, 19 nt, Artificial Sequence
  Synthetic Oligonucleotide
aaucaucaaaggccaaagu

SEQ ID NO: 4426 - RNA, 19 nt, Artificial Sequence
  Synthetic Oligonucleotide
augauuucuuagcugagau

SEQ ID NO: 4427 - RNA, 19 nt, Artificial Sequence
  Synthetic Oligonucleotide
gauuucuuagcugagauuu

SEQ ID NO: 4428 - RNA, 19 nt, Artificial Sequence
  Synthetic Oligonucleotide
uuucuuagcugagauuuuu

SEQ ID NO: 4429 - RNA, 19 nt, Artificial Sequence
  Synthetic Oligonucleotide
ucuuagcugagauuuuuaa

SEQ ID NO: 4430 - RNA, 19 nt, Artificial Sequence
  Synthetic Oligonucleotide
uuagcugagauuuuuaaga

SEQ ID NO: 4431 - RNA, 19 nt, Artificial Sequence
  Synthetic Oligonucleotide
agcugagauuuuuaagaag

SEQ ID NO: 4432 - RNA, 19 nt, Artificial Sequence
  Synthetic Oligonucleotide
cugagauuuuuaagaagau

SEQ ID NO: 4433 - RNA, 19 nt, Artificial Sequence
  Synthetic Oligonucleotide
gagauuuuuaagaagauug

SEQ ID NO: 4434 - RNA, 19 nt, Artificial Sequence
  Synthetic Oligonucleotide
gauuuuuaagaagauuggc

SEQ ID NO: 4435 - RNA, 19 nt, Artificial Sequence
  Synthetic Oligonucleotide
uuuuuaagaagauuggcuc

SEQ ID NO: 4436 - RNA, 19 nt, Artificial Sequence
  Synthetic Oligonucleotide
uagcagaguuauaugaaua

SEQ ID NO: 4437 - RNA, 19 nt, Artificial Sequence
  Synthetic Oligonucleotide
gcagaguuauaugaauaua

SEQ ID NO: 4438 - RNA, 19 nt, Artificial Sequence
  Synthetic Oligonucleotide
agaguuauaugaauauaag

SEQ ID NO: 4439 - RNA, 19 nt, Artificial Sequence
  Synthetic Oligonucleotide
aguuauaugaauauaagaa

SEQ ID NO: 4440 - RNA, 19 nt, Artificial Sequence
  Synthetic Oligonucleotide
uuauaugaauauaagaaga

SEQ ID NO: 4441 - RNA, 19 nt, Artificial Sequence
  Synthetic Oligonucleotide
auaugaauauaagaagaaa

SEQ ID NO: 4442 - RNA, 19 nt, Artificial Sequence
  Synthetic Oligonucleotide
augaauauaagaagaaaua

SEQ ID NO: 4443 - RNA, 19 nt, Artificial Sequence
  Synthetic Oligonucleotide
ugacauugaaccauuucug

SEQ ID NO: 4444 - RNA, 19 nt, Artificial Sequence
  Synthetic Oligonucleotide
acauugaaccauuucugaa

SEQ ID NO: 4445 - RNA, 19 nt, Artificial Sequence
  Synthetic Oligonucleotide
auugaaccauuucugaaaa

SEQ ID NO: 4446 - RNA, 19 nt, Artificial Sequence
  Synthetic Oligonucleotide
ugaaccauuucugaaaaau

SEQ ID NO: 4447 - RNA, 19 nt, Artificial Sequence
  Synthetic Oligonucleotide
aaccauuucugaaaaauuc

SEQ ID NO: 4448 - RNA, 19 nt, Artificial Sequence
  Synthetic Oligonucleotide
ccauuucugaaaaauuccu

SEQ ID NO: 4449 - RNA, 19 nt, Artificial Sequence
  Synthetic Oligonucleotide
agaggccuucgggugauug

SEQ ID NO: 4450 - RNA, 19 nt, Artificial Sequence
  Synthetic Oligonucleotide
aggccuucgggugauugag

SEQ ID NO: 4451 - RNA, 19 nt, Artificial Sequence
  Synthetic Oligonucleotide
gccuucgggugauugagau

SEQ ID NO: 4452 - RNA, 19 nt, Artificial Sequence
  Synthetic Oligonucleotide
cuucgggugauugagaugg

SEQ ID NO: 4453 - RNA, 19 nt, Artificial Sequence
  Synthetic Oligonucleotide
ucgggugauugagauggag

SEQ ID NO: 4454 - RNA, 19 nt, Artificial Sequence
  Synthetic Oligonucleotide
gggugauugagauggagag

SEQ ID NO: 4455 - RNA, 19 nt, Artificial Sequence
  Synthetic Oligonucleotide
ccaucugucuacuuggaaa

SEQ ID NO: 4456 - RNA, 19 nt, Artificial Sequence
  Synthetic Oligonucleotide
aucugucuacuuggaaagg

SEQ ID NO: 4457 - RNA, 19 nt, Artificial Sequence
  Synthetic Oligonucleotide
cugucuacuuggaaaggcu

SEQ ID NO: 4458 - RNA, 19 nt, Artificial Sequence
  Synthetic Oligonucleotide
gucuacuuggaaaggcuaa

SEQ ID NO: 4459 - RNA, 19 nt, Artificial Sequence
  Synthetic Oligonucleotide
ugaccucuuugcucuccaa

SEQ ID NO: 4460 - RNA, 19 nt, Artificial Sequence
  Synthetic Oligonucleotide
accucuuugcucuccaaac

SEQ ID NO: 4461 - RNA, 19 nt, Artificial Sequence
  Synthetic Oligonucleotide
cucuuugcucuccaaacca

SEQ ID NO: 4462 - RNA, 19 nt, Artificial Sequence
  Synthetic Oligonucleotide
cuuugcucuccaaaccagc

SEQ ID NO: 4463 - RNA, 19 nt, Artificial Sequence
  Synthetic Oligonucleotide
ugaccuccuccuccuccac

SEQ ID NO: 4464 - RNA, 19 nt, Artificial Sequence
  Synthetic Oligonucleotide
agacuggagagaauaaaga

SEQ ID NO: 4465 - RNA, 19 nt, Artificial Sequence
  Synthetic Oligonucleotide
acuggagagaauaaagagc

SEQ ID NO: 4466 - RNA, 19 nt, Artificial Sequence
  Synthetic Oligonucleotide
uggagagaauaaagagcag

SEQ ID NO: 4467 - RNA, 19 nt, Artificial Sequence
  Synthetic Oligonucleotide
gagagaauaaagagcaguc

SEQ ID NO: 4468 - RNA, 19 nt, Artificial Sequence
  Synthetic Oligonucleotide
gagaauaaagagcagucgc

SEQ ID NO: 4469 - RNA, 19 nt, Artificial Sequence
  Synthetic Oligonucleotide
gaauaaagagcagucgcaa

SEQ ID NO: 4470 - RNA, 19 nt, Artificial Sequence
  Synthetic Oligonucleotide
auaaagagcagucgcaaau

SEQ ID NO: 4471 - RNA, 19 nt, Artificial Sequence
  Synthetic Oligonucleotide
aaagagcagucgcaaauga

SEQ ID NO: 4472 - RNA, 19 nt, Artificial Sequence
  Synthetic Oligonucleotide
agagcagucgcaaaugaag

SEQ ID NO: 4473 - RNA, 19 nt, Artificial Sequence
  Synthetic Oligonucleotide
aaacugguuguauguauca

SEQ ID NO: 4474 - RNA, 19 nt, Artificial Sequence
  Synthetic Oligonucleotide
cucauuuguaaaauugucc

SEQ ID NO: 4475 - RNA, 19 nt, Artificial Sequence
  Synthetic Oligonucleotide
cauuuguaaaauuguccua

SEQ ID NO: 4476 - RNA, 19 nt, Artificial Sequence
  Synthetic Oligonucleotide
uuuguaaaauuguccuaau

SEQ ID NO: 4477 - RNA, 19 nt, Artificial Sequence
  Synthetic Oligonucleotide
acuguauucuguaugaaug

SEQ ID NO: 4478 - RNA, 19 nt, Artificial Sequence
  Synthetic Oligonucleotide
uguauucuguaugaaugca

SEQ ID NO: 4479 - RNA, 19 nt, Artificial Sequence
  Synthetic Oligonucleotide
uauucuguaugaaugcaug

SEQ ID NO: 4480 - RNA, 19 nt, Artificial Sequence
  Synthetic Oligonucleotide
uucuguaugaaugcauggc

SEQ ID NO: 4481 - RNA, 19 nt, Artificial Sequence
  Synthetic Oligonucleotide
cuguaugaaugcauggcau

SEQ ID NO: 4482 - RNA, 19 nt, Artificial Sequence
  Synthetic Oligonucleotide
guaugaaugcauggcauga

SEQ ID NO: 4483 - RNA, 19 nt, Artificial Sequence
  Synthetic Oligonucleotide
uuuuauaaauaaaguuugc

SEQ ID NO: 4484 - RNA, 19 nt, Artificial Sequence
  Synthetic Oligonucleotide
uuauaaauaaaguuugcau

SEQ ID NO: 4485 - RNA, 19 nt, Artificial Sequence
  Synthetic Oligonucleotide
auaaauaaaguuugcauua

SEQ ID NO: 4486 - RNA, 19 nt, Artificial Sequence
  Synthetic Oligonucleotide
aaauaaaguuugcauuaac

SEQ ID NO: 4487 - RNA, 19 nt, Artificial Sequence
  Synthetic Oligonucleotide
auaaaguuugcauuaacua

SEQ ID NO: 4488 - RNA, 19 nt, Artificial Sequence
  Synthetic Oligonucleotide
aaaguuugcauuaacuaua

SEQ ID NO: 4489 - RNA, 19 nt, Artificial Sequence
  Synthetic Oligonucleotide
cagcugaggaaauacucuu

SEQ ID NO: 4490 - RNA, 19 nt, Artificial Sequence
  Synthetic Oligonucleotide
uugaaacugccaguugauc

SEQ ID NO: 4491 - RNA, 19 nt, Artificial Sequence
  Synthetic Oligonucleotide
gccaguugaucagaaaugu

SEQ ID NO: 4492 - RNA, 19 nt, Artificial Sequence
  Synthetic Oligonucleotide
gaaagcaagguuaaguggg

SEQ ID NO: 4493 - RNA, 19 nt, Artificial Sequence
  Synthetic Oligonucleotide
cagagugguccaaauuuuu

SEQ ID NO: 4494 - RNA, 19 nt, Artificial Sequence
  Synthetic Oligonucleotide
gugguucaauugaaaggau

SEQ ID NO: 4495 - RNA, 19 nt, Artificial Sequence
  Synthetic Oligonucleotide
gauuagaagcugcacuugu

SEQ ID NO: 4496 - RNA, 19 nt, Artificial Sequence
  Synthetic Oligonucleotide
cugcacuuguuuauguuga

SEQ ID NO: 4497 - RNA, 19 nt, Artificial Sequence
  Synthetic Oligonucleotide
caggaaaaaccacaggaga

SEQ ID NO: 4498 - RNA, 19 nt, Artificial Sequence
  Synthetic Oligonucleotide
cagguguuguaaguaaggu

SEQ ID NO: 4499 - RNA, 19 nt, Artificial Sequence
  Synthetic Oligonucleotide
guuguaaguaagguguuca

SEQ ID NO: 4500 - RNA, 19 nt, Artificial Sequence
  Synthetic Oligonucleotide
ucaaucaaccuaaagcuaa

SEQ ID NO: 4501 - RNA, 19 nt, Artificial Sequence
  Synthetic Oligonucleotide
ccugaaaggcuuggacaau

SEQ ID NO: 4502 - RNA, 19 nt, Artificial Sequence
  Synthetic Oligonucleotide
aagccaauuaucaaagugu

SEQ ID NO: 4503 - RNA, 19 nt, Artificial Sequence
  Synthetic Oligonucleotide
aaaguguugccaaaacucu

SEQ ID NO: 4504 - RNA, 19 nt, Artificial Sequence
  Synthetic Oligonucleotide
caaaacucuuugagucucg

SEQ ID NO: 4505 - RNA, 19 nt, Artificial Sequence
  Synthetic Oligonucleotide
cuguucgagaugaagccaa

SEQ ID NO: 4506 - RNA, 19 nt, Artificial Sequence
  Synthetic Oligonucleotide
cauuacaaaauauaaacuc

SEQ ID NO: 4507 - RNA, 19 nt, Artificial Sequence
  Synthetic Oligonucleotide
aaaauauaaacucuguuca

SEQ ID NO: 4508 - RNA, 19 nt, Artificial Sequence
  Synthetic Oligonucleotide
auaaacucuguucaguuga

SEQ ID NO: 4509 - RNA, 19 nt, Artificial Sequence
  Synthetic Oligonucleotide
cuguucaguugaaagaacu

SEQ ID NO: 4510 - RNA, 19 nt, Artificial Sequence
  Synthetic Oligonucleotide
gaugaggugccacaaauag

SEQ ID NO: 4511 - RNA, 19 nt, Artificial Sequence
  Synthetic Oligonucleotide
aaauagaugcuuaugagcu

SEQ ID NO: 4512 - RNA, 19 nt, Artificial Sequence
  Synthetic Oligonucleotide
augagcuuuuagaagcugu

SEQ ID NO: 4513 - RNA, 19 nt, Artificial Sequence
  Synthetic Oligonucleotide
cccuggagucuguagaagu

SEQ ID NO: 4514 - RNA, 19 nt, Artificial Sequence
  Synthetic Oligonucleotide
gagucuguagaaguacuaa

SEQ ID NO: 4515 - RNA, 19 nt, Artificial Sequence
  Synthetic Oligonucleotide
cagauuuaguaaaagcauu

SEQ ID NO: 4516 - RNA, 19 nt, Artificial Sequence
  Synthetic Oligonucleotide
aaaagcauuaaagaagguu

SEQ ID NO: 4517 - RNA, 19 nt, Artificial Sequence
  Synthetic Oligonucleotide
cauuaaagaagguuguugg

SEQ ID NO: 4518 - RNA, 19 nt, Artificial Sequence
  Synthetic Oligonucleotide
gaagguuguuggaaaggac

SEQ ID NO: 4519 - RNA, 19 nt, Artificial Sequence
  Synthetic Oligonucleotide
ggaagaaauuuggacaaua

SEQ ID NO: 4520 - RNA, 19 nt, Artificial Sequence
  Synthetic Oligonucleotide
gugaggauguuuuagcagu

SEQ ID NO: 4521 - RNA, 19 nt, Artificial Sequence
  Synthetic Oligonucleotide
guuuuagcaguaauggaua

SEQ ID NO: 4522 - RNA, 19 nt, Artificial Sequence
  Synthetic Oligonucleotide
caagcagcagacaucucuu

SEQ ID NO: 4523 - RNA, 19 nt, Artificial Sequence
  Synthetic Oligonucleotide
gacaucucuuuuuauugca

SEQ ID NO: 4524 - RNA, 19 nt, Artificial Sequence
  Synthetic Oligonucleotide
ucagagaugccgcauuuga

SEQ ID NO: 4525 - RNA, 19 nt, Artificial Sequence
  Synthetic Oligonucleotide
cauuggguacugcuuugaa

SEQ ID NO: 4526 - RNA, 19 nt, Artificial Sequence
  Synthetic Oligonucleotide
guggacaaacucaagcuug

SEQ ID NO: 4527 - RNA, 19 nt, Artificial Sequence
  Synthetic Oligonucleotide
aagaauguucagaaaaggu

SEQ ID NO: 4528 - RNA, 19 nt, Artificial Sequence
  Synthetic Oligonucleotide
ucagaaaagguagaacuga

SEQ ID NO: 4529 - RNA, 19 nt, Artificial Sequence
  Synthetic Oligonucleotide
gguagaacugauacauggu

SEQ ID NO: 4530 - RNA, 19 nt, Artificial Sequence
  Synthetic Oligonucleotide
cagggaauacuggaaccaa

SEQ ID NO: 4531 - RNA, 19 nt, Artificial Sequence
  Synthetic Oligonucleotide
ccugagcucucgauagaag

SEQ ID NO: 4532 - RNA, 19 nt, Artificial Sequence
  Synthetic Oligonucleotide
cgauagaaguaugugaaga

SEQ ID NO: 4533 - RNA, 19 nt, Artificial Sequence
  Synthetic Oligonucleotide
cuugacagcaguaacugga

SEQ ID NO: 4534 - RNA, 19 nt, Artificial Sequence
  Synthetic Oligonucleotide
gcuaauggaccgaacugaa

SEQ ID NO: 4535 - RNA, 19 nt, Artificial Sequence
  Synthetic Oligonucleotide
uuagugaggaugcuagcca

SEQ ID NO: 4536 - RNA, 19 nt, Artificial Sequence
  Synthetic Oligonucleotide
gccaagaaaccuggaugga

SEQ ID NO: 4537 - RNA, 19 nt, Artificial Sequence
  Synthetic Oligonucleotide
gaaaccuggauggaaagaa

SEQ ID NO: 4538 - RNA, 19 nt, Artificial Sequence
  Synthetic Oligonucleotide
gugaugcaaaugaagcuuc

SEQ ID NO: 4539 - RNA, 19 nt, Artificial Sequence
  Synthetic Oligonucleotide
aaacgucagcucagguugu

SEQ ID NO: 4540 - RNA, 19 nt, Artificial Sequence
  Synthetic Oligonucleotide
caaaagaagcuaugacagc

SEQ ID NO: 4541 - RNA, 19 nt, Artificial Sequence
  Synthetic Oligonucleotide
cagcaauagccgaagccug

SEQ ID NO: 4542 - RNA, 19 nt, Artificial Sequence
  Synthetic Oligonucleotide
gaagccuguauguuaccau

SEQ ID NO: 4543 - RNA, 19 nt, Artificial Sequence
  Synthetic Oligonucleotide
aaaaucagucagaaacucu

SEQ ID NO: 4544 - RNA, 19 nt, Artificial Sequence
  Synthetic Oligonucleotide
agcuuucauuagcaaugug

SEQ ID NO: 4545 - RNA, 19 nt, Artificial Sequence
  Synthetic Oligonucleotide
gagaagaugcagggacaaa

SEQ ID NO: 4546 - RNA, 19 nt, Artificial Sequence
  Synthetic Oligonucleotide
gcaaugaugucguugaucu

SEQ ID NO: 4547 - RNA, 19 nt, Artificial Sequence
  Synthetic Oligonucleotide
gaaguggcagguauuauua

SEQ ID NO: 4548 - RNA, 19 nt, Artificial Sequence
  Synthetic Oligonucleotide
gccuugaagggucgacuca

SEQ ID NO: 4549 - RNA, 19 nt, Artificial Sequence
  Synthetic Oligonucleotide
gaagggucgacucaaugau

SEQ ID NO: 4550 - RNA, 19 nt, Artificial Sequence
  Synthetic Oligonucleotide
gacucaaugauucaaauaa

SEQ ID NO: 4551 - RNA, 19 nt, Artificial Sequence
  Synthetic Oligonucleotide
augauucaaauaaaaucuu

SEQ ID NO: 4552 - RNA, 19 nt, Artificial Sequence
  Synthetic Oligonucleotide
agccaugggcccaaauauu

SEQ ID NO: 4553 - RNA, 19 nt, Artificial Sequence
  Synthetic Oligonucleotide
aaauauuaagcaacaugua

SEQ ID NO: 4554 - RNA, 19 nt, Artificial Sequence
  Synthetic Oligonucleotide
ccuuggagacagcaagaac

SEQ ID NO: 4555 - RNA, 19 nt, Artificial Sequence
  Synthetic Oligonucleotide
gagacagcaagaacaaugu

SEQ ID NO: 4556 - RNA, 19 nt, Artificial Sequence
  Synthetic Oligonucleotide
caugaugcauuuaggauau

SEQ ID NO: 4557 - RNA, 19 nt, Artificial Sequence
  Synthetic Oligonucleotide
cuagagaaagccaaaguua

SEQ ID NO: 4558 - RNA, 19 nt, Artificial Sequence
  Synthetic Oligonucleotide
gggaagaagaugccaagca

SEQ ID NO: 4559 - RNA, 19 nt, Artificial Sequence
  Synthetic Oligonucleotide
gaaaagagcaaaggaugaa

SEQ ID NO: 4560 - RNA, 19 nt, Artificial Sequence
  Synthetic Oligonucleotide
gagcaaaggaugaaagaug

SEQ ID NO: 4561 - RNA, 19 nt, Artificial Sequence
  Synthetic Oligonucleotide
gggaugaauacauugagca

SEQ ID NO: 4562 - RNA, 19 nt, Artificial Sequence
  Synthetic Oligonucleotide
gaauacauugagcaacuaa

SEQ ID NO: 4563 - RNA, 19 nt, Artificial Sequence
  Synthetic Oligonucleotide
aguggcuuacccugagguu

SEQ ID NO: 4564 - RNA, 19 nt, Artificial Sequence
  Synthetic Oligonucleotide
ccugagguuuuuugacacc

SEQ ID NO: 4565 - RNA, 19 nt, Artificial Sequence
  Synthetic Oligonucleotide
caauacaagcguccugaug

SEQ ID NO: 4566 - RNA, 19 nt, Artificial Sequence
  Synthetic Oligonucleotide
guccugaugaaagcacuag

SEQ ID NO: 4567 - RNA, 19 nt, Artificial Sequence
  Synthetic Oligonucleotide
augaaagcacuagaauauu

SEQ ID NO: 4568 - RNA, 19 nt, Artificial Sequence
  Synthetic Oligonucleotide
gaaaucuuucugaaaagga

SEQ ID NO: 4569 - RNA, 19 nt, Artificial Sequence
  Synthetic Oligonucleotide
gaaaaggauaugagcaugc

SEQ ID NO: 4570 - RNA, 19 nt, Artificial Sequence
  Synthetic Oligonucleotide
gcuccaaugccaacauguu

SEQ ID NO: 4571 - RNA, 19 nt, Artificial Sequence
  Synthetic Oligonucleotide
aaugccaacauguuacgca

SEQ ID NO: 4572 - RNA, 19 nt, Artificial Sequence
  Synthetic Oligonucleotide
gugaaaugccagaacuugu

SEQ ID NO: 4573 - RNA, 19 nt, Artificial Sequence
  Synthetic Oligonucleotide
cagaacuuguucagcacaa

SEQ ID NO: 4574 - RNA, 19 nt, Artificial Sequence
  Synthetic Oligonucleotide
acaaacuggaugacauuuu

SEQ ID NO: 4575 - RNA, 19 nt, Artificial Sequence
  Synthetic Oligonucleotide
gaugacauuuuugagccag

SEQ ID NO: 4576 - RNA, 19 nt, Artificial Sequence
  Synthetic Oligonucleotide
cauuuuugagccaguccuu

SEQ ID NO: 4577 - RNA, 19 nt, Artificial Sequence
  Synthetic Oligonucleotide
gagccaguccuuauuccug

SEQ ID NO: 4578 - RNA, 19 nt, Artificial Sequence
  Synthetic Oligonucleotide
cuggaguacuaaaagaccu

SEQ ID NO: 4579 - RNA, 19 nt, Artificial Sequence
  Synthetic Oligonucleotide
gugaagguucuggagaagu

SEQ ID NO: 4580 - RNA, 19 nt, Artificial Sequence
  Synthetic Oligonucleotide
ccugagugcccuacuuguu

SEQ ID NO: 4581 - RNA, 19 nt, Artificial Sequence
  Synthetic Oligonucleotide
cagccaguucucccaaauu

SEQ ID NO: 4582 - RNA, 19 nt, Artificial Sequence
  Synthetic Oligonucleotide
gcuuguuaugaagugucuc

SEQ ID NO: 4583 - RNA, 19 nt, Artificial Sequence
  Synthetic Oligonucleotide
cgacuguugccugauacca

SEQ ID NO: 4584 - RNA, 19 nt, Artificial Sequence
  Synthetic Oligonucleotide
guugccugauaccaucaau

SEQ ID NO: 4585 - RNA, 19 nt, Artificial Sequence
  Synthetic Oligonucleotide
cugauaccaucaauagcau

SEQ ID NO: 4586 - RNA, 19 nt, Artificial Sequence
  Synthetic Oligonucleotide
aucaauagcauuaaccuag

SEQ ID NO: 4587 - RNA, 19 nt, Artificial Sequence
  Synthetic Oligonucleotide
uagcauuaaccuagacaga

SEQ ID NO: 4588 - RNA, 19 nt, Artificial Sequence
  Synthetic Oligonucleotide
gaauucuucuggauaucca

SEQ ID NO: 4589 - RNA, 19 nt, Artificial Sequence
  Synthetic Oligonucleotide
cuggauauccacauuuuca

SEQ ID NO: 4590 - RNA, 19 nt, Artificial Sequence
  Synthetic Oligonucleotide
aaagagaaacugaagcaau

SEQ ID NO: 4591 - RNA, 19 nt, Artificial Sequence
  Synthetic Oligonucleotide
gaaacugaagcaaugcaaa

SEQ ID NO: 4592 - RNA, 19 nt, Artificial Sequence
  Synthetic Oligonucleotide
cggaugaugaagcacagua

SEQ ID NO: 4593 - RNA, 19 nt, Artificial Sequence
  Synthetic Oligonucleotide
cagaaaagggagcaucucg

SEQ ID NO: 4594 - RNA, 19 nt, Artificial Sequence
  Synthetic Oligonucleotide
agggagcaucucgaauaga

SEQ ID NO: 4595 - RNA, 19 nt, Artificial Sequence
  Synthetic Oligonucleotide
gcaucucgaauagaugaaa

SEQ ID NO: 4596 - RNA, 19 nt, Artificial Sequence
  Synthetic Oligonucleotide
gagggacuagcagaguuau

SEQ ID NO: 4597 - RNA, 19 nt, Artificial Sequence
  Synthetic Oligonucleotide
acucagaugcugacauuga

SEQ ID NO: 4598 - RNA, 19 nt, Artificial Sequence
  Synthetic Oligonucleotide
cauucagaccuggauucua

SEQ ID NO: 4599 - RNA, 19 nt, Artificial Sequence
  Synthetic Oligonucleotide
gaccuggauucuaaccaga

SEQ ID NO: 4600 - RNA, 19 nt, Artificial Sequence
  Synthetic Oligonucleotide
ggauucuaaccagacucac

SEQ ID NO: 4601 - RNA, 19 nt, Artificial Sequence
  Synthetic Oligonucleotide
gcuaacauagacgacuuga

SEQ ID NO: 4602 - RNA, 19 nt, Artificial Sequence
  Synthetic Oligonucleotide
cauagacgacuugaaaaaa

SEQ ID NO: 4603 - RNA, 19 nt, Artificial Sequence
  Synthetic Oligonucleotide
cuagaaguccucauaguuu

SEQ ID NO: 4604 - RNA, 19 nt, Artificial Sequence
  Synthetic Oligonucleotide
gaugaguuuaguguacaga

SEQ ID NO: 4605 - RNA, 19 nt, Artificial Sequence
  Synthetic Oligonucleotide
cagauccuuuucuuuucuu

SEQ ID NO: 4606 - RNA, 19 nt, Artificial Sequence
  Synthetic Oligonucleotide
ugcucauuuguaaaauugu

SEQ ID NO: 4607 - RNA, 19 nt, Artificial Sequence
  Synthetic Oligonucleotide
gaagggucacuguauucug

SEQ ID NO: 4608 - RNA, 19 nt, Artificial Sequence
  Synthetic Oligonucleotide
gucacuguauucuguauga

SEQ ID NO: 4609 - RNA, 19 nt, Artificial Sequence
  Synthetic Oligonucleotide
ggaagcacaaugggagaug

SEQ ID NO: 4610 - RNA, 19 nt, Artificial Sequence
  Synthetic Oligonucleotide
aagcacaaugggagaugac

SEQ ID NO: 4611 - RNA, 19 nt, Artificial Sequence
  Synthetic Oligonucleotide
gcacaaugggagaugacag

SEQ ID NO: 4612 - RNA, 19 nt, Artificial Sequence
  Synthetic Oligonucleotide
acaaugggagaugacagug

SEQ ID NO: 4613 - RNA, 19 nt, Artificial Sequence
  Synthetic Oligonucleotide
aaugggagaugacagugag

SEQ ID NO: 4614 - RNA, 19 nt, Artificial Sequence
  Synthetic Oligonucleotide
ugggagaugacagugagug

SEQ ID NO: 4615 - RNA, 19 nt, Artificial Sequence
  Synthetic Oligonucleotide
ggagaugacagugaguggu

SEQ ID NO: 4616 - RNA, 19 nt, Artificial Sequence
  Synthetic Oligonucleotide
agaugacagugagugguug

SEQ ID NO: 4617 - RNA, 19 nt, Artificial Sequence
  Synthetic Oligonucleotide
augacagugagugguugaa

SEQ ID NO: 4618 - RNA, 19 nt, Artificial Sequence
  Synthetic Oligonucleotide
ugaagaucuuccagaaaau

SEQ ID NO: 4619 - RNA, 19 nt, Artificial Sequence
  Synthetic Oligonucleotide
aagaucuuccagaaaauaa

SEQ ID NO: 4620 - RNA, 19 nt, Artificial Sequence
  Synthetic Oligonucleotide
gaucuuccagaaaauaaag

SEQ ID NO: 4621 - RNA, 19 nt, Artificial Sequence
  Synthetic Oligonucleotide
ucuuccagaaaauaaagga

SEQ ID NO: 4622 - RNA, 19 nt, Artificial Sequence
  Synthetic Oligonucleotide
uuccagaaaauaaaggaug

SEQ ID NO: 4623 - RNA, 19 nt, Artificial Sequence
  Synthetic Oligonucleotide
ccagaaaauaaaggaugaa

SEQ ID NO: 4624 - RNA, 19 nt, Artificial Sequence
  Synthetic Oligonucleotide
agaaaauaaaggaugaaaa

SEQ ID NO: 4625 - RNA, 19 nt, Artificial Sequence
  Synthetic Oligonucleotide
aaaauaaaggaugaaaaga

SEQ ID NO: 4626 - RNA, 19 nt, Artificial Sequence
  Synthetic Oligonucleotide
aucaaaaaauuugucacug

SEQ ID NO: 4627 - RNA, 19 nt, Artificial Sequence
  Synthetic Oligonucleotide
caaaaaauuugucacugau

SEQ ID NO: 4628 - RNA, 19 nt, Artificial Sequence
  Synthetic Oligonucleotide
aaaaauuugucacugauuc

SEQ ID NO: 4629 - RNA, 19 nt, Artificial Sequence
  Synthetic Oligonucleotide
aaauuugucacugauucca

SEQ ID NO: 4630 - RNA, 19 nt, Artificial Sequence
  Synthetic Oligonucleotide
auuugucacugauuccaau

SEQ ID NO: 4631 - RNA, 19 nt, Artificial Sequence
  Synthetic Oligonucleotide
uugucacugauuccaaugc

SEQ ID NO: 4632 - RNA, 19 nt, Artificial Sequence
  Synthetic Oligonucleotide
gucacugauuccaaugcag

SEQ ID NO: 4633 - RNA, 19 nt, Artificial Sequence
  Synthetic Oligonucleotide
cacugauuccaaugcagug

SEQ ID NO: 4634 - RNA, 19 nt, Artificial Sequence
  Synthetic Oligonucleotide
cugauuccaaugcaguggu

SEQ ID NO: 4635 - RNA, 19 nt, Artificial Sequence
  Synthetic Oligonucleotide
gauuccaaugcagugguuc

SEQ ID NO: 4636 - RNA, 19 nt, Artificial Sequence
  Synthetic Oligonucleotide
uuccaaugcagugguucaa

SEQ ID NO: 4637 - RNA, 19 nt, Artificial Sequence
  Synthetic Oligonucleotide
ccaaugcagugguucaauu

SEQ ID NO: 4638 - RNA, 19 nt, Artificial Sequence
  Synthetic Oligonucleotide
aaugcagugguucaauuga

SEQ ID NO: 4639 - RNA, 19 nt, Artificial Sequence
  Synthetic Oligonucleotide
ugcagugguucaauugaaa

SEQ ID NO: 4640 - RNA, 19 nt, Artificial Sequence
  Synthetic Oligonucleotide
cagugguucaauugaaagg

SEQ ID NO: 4641 - RNA, 19 nt, Artificial Sequence
  Synthetic Oligonucleotide
caagaucauaguggccugu

SEQ ID NO: 4642 - RNA, 19 nt, Artificial Sequence
  Synthetic Oligonucleotide
agaucauaguggccuguau

SEQ ID NO: 4643 - RNA, 19 nt, Artificial Sequence
  Synthetic Oligonucleotide
aucauaguggccuguauag

SEQ ID NO: 4644 - RNA, 19 nt, Artificial Sequence
  Synthetic Oligonucleotide
acacugaggaaagccuuaa

SEQ ID NO: 4645 - RNA, 19 nt, Artificial Sequence
  Synthetic Oligonucleotide
acugaggaaagccuuaagu

SEQ ID NO: 4646 - RNA, 19 nt, Artificial Sequence
  Synthetic Oligonucleotide
ugaggaaagccuuaaguga

SEQ ID NO: 4647 - RNA, 19 nt, Artificial Sequence
  Synthetic Oligonucleotide
aggaaagccuuaagugaau

SEQ ID NO: 4648 - RNA, 19 nt, Artificial Sequence
  Synthetic Oligonucleotide
gaaagccuuaagugaauuu

SEQ ID NO: 4649 - RNA, 19 nt, Artificial Sequence
  Synthetic Oligonucleotide
aagccuuaagugaauuugg

SEQ ID NO: 4650 - RNA, 19 nt, Artificial Sequence
  Synthetic Oligonucleotide
gccuuaagugaauuugguu

SEQ ID NO: 4651 - RNA, 19 nt, Artificial Sequence
  Synthetic Oligonucleotide
cuuaagugaauuugguucc

SEQ ID NO: 4652 - RNA, 19 nt, Artificial Sequence
  Synthetic Oligonucleotide
uaagugaauuugguuccaa

SEQ ID NO: 4653 - RNA, 19 nt, Artificial Sequence
  Synthetic Oligonucleotide
agugaauuugguuccaaaa

SEQ ID NO: 4654 - RNA, 19 nt, Artificial Sequence
  Synthetic Oligonucleotide
ugaauuugguuccaaaauc

SEQ ID NO: 4655 - RNA, 19 nt, Artificial Sequence
  Synthetic Oligonucleotide
aauuugguuccaaaaucau

SEQ ID NO: 4656 - RNA, 19 nt, Artificial Sequence
  Synthetic Oligonucleotide
ucguucccaacaagaacua

SEQ ID NO: 4657 - RNA, 19 nt, Artificial Sequence
  Synthetic Oligonucleotide
guucccaacaagaacuaga

SEQ ID NO: 4658 - RNA, 19 nt, Artificial Sequence
  Synthetic Oligonucleotide
ucccaacaagaacuagaag

SEQ ID NO: 4659 - RNA, 19 nt, Artificial Sequence
  Synthetic Oligonucleotide
ccaacaagaacuagaagcu

SEQ ID NO: 4660 - RNA, 19 nt, Artificial Sequence
  Synthetic Oligonucleotide
aacaagaacuagaagcuaa

SEQ ID NO: 4661 - RNA, 19 nt, Artificial Sequence
  Synthetic Oligonucleotide
caacagucugcugguggag

SEQ ID NO: 4662 - RNA, 19 nt, Artificial Sequence
  Synthetic Oligonucleotide
acagucugcugguggagau

SEQ ID NO: 4663 - RNA, 19 nt, Artificial Sequence
  Synthetic Oligonucleotide
gguggugaugauggugaug

SEQ ID NO: 4664 - RNA, 19 nt, Artificial Sequence
  Synthetic Oligonucleotide
uggugaugauggugaugag

SEQ ID NO: 4665 - RNA, 19 nt, Artificial Sequence
  Synthetic Oligonucleotide
aauccuuuccaaacuuccc

SEQ ID NO: 4666 - RNA, 19 nt, Artificial Sequence
  Synthetic Oligonucleotide
uccuuuccaaacuucccaa

SEQ ID NO: 4667 - RNA, 19 nt, Artificial Sequence
  Synthetic Oligonucleotide
cuuuccaaacuucccaaag

SEQ ID NO: 4668 - RNA, 19 nt, Artificial Sequence
  Synthetic Oligonucleotide
uuccaaacuucccaaagac

SEQ ID NO: 4669 - RNA, 19 nt, Artificial Sequence
  Synthetic Oligonucleotide
ccaaacuucccaaagacuu

SEQ ID NO: 4670 - RNA, 19 nt, Artificial Sequence
  Synthetic Oligonucleotide
aaacuucccaaagacuuuu

SEQ ID NO: 4671 - RNA, 19 nt, Artificial Sequence
  Synthetic Oligonucleotide
acuucccaaagacuuuuau

SEQ ID NO: 4672 - RNA, 19 nt, Artificial Sequence
  Synthetic Oligonucleotide
uucccaaagacuuuuauga

SEQ ID NO: 4673 - RNA, 19 nt, Artificial Sequence
  Synthetic Oligonucleotide
cccaaagacuuuuaugaca

SEQ ID NO: 4674 - RNA, 19 nt, Artificial Sequence
  Synthetic Oligonucleotide
caaagacuuuuaugacaaa

SEQ ID NO: 4675 - RNA, 19 nt, Artificial Sequence
  Synthetic Oligonucleotide
aagacuuuuaugacaaaau

SEQ ID NO: 4676 - RNA, 19 nt, Artificial Sequence
  Synthetic Oligonucleotide
gacuuuuaugacaaaauug

SEQ ID NO: 4677 - RNA, 19 nt, Artificial Sequence
  Synthetic Oligonucleotide
cuuuuaugacaaaauugag

SEQ ID NO: 4678 - RNA, 19 nt, Artificial Sequence
  Synthetic Oligonucleotide
uuuaugacaaaauugaggc

SEQ ID NO: 4679 - RNA, 19 nt, Artificial Sequence
  Synthetic Oligonucleotide
uaugacaaaauugaggcaa

SEQ ID NO: 4680 - RNA, 19 nt, Artificial Sequence
  Synthetic Oligonucleotide
aaauggcaagagagaaaag

SEQ ID NO: 4681 - RNA, 19 nt, Artificial Sequence
  Synthetic Oligonucleotide
aagguuguuggaaaggaca

SEQ ID NO: 4682 - RNA, 19 nt, Artificial Sequence
  Synthetic Oligonucleotide
gguuguuggaaaggacacc

SEQ ID NO: 4683 - RNA, 19 nt, Artificial Sequence
  Synthetic Oligonucleotide
uuguuggaaaggacaccaa

SEQ ID NO: 4684 - RNA, 19 nt, Artificial Sequence
  Synthetic Oligonucleotide
guuggaaaggacaccaaug

SEQ ID NO: 4685 - RNA, 19 nt, Artificial Sequence
  Synthetic Oligonucleotide
uggaaaggacaccaauguc

SEQ ID NO: 4686 - RNA, 19 nt, Artificial Sequence
  Synthetic Oligonucleotide
gaaaggacaccaaugucau

SEQ ID NO: 4687 - RNA, 19 nt, Artificial Sequence
  Synthetic Oligonucleotide
aaggacaccaaugucaugu

SEQ ID NO: 4688 - RNA, 19 nt, Artificial Sequence
  Synthetic Oligonucleotide
ggacaccaaugucauguug

SEQ ID NO: 4689 - RNA, 19 nt, Artificial Sequence
  Synthetic Oligonucleotide
ggcuuuggcagcaaaaugu

SEQ ID NO: 4690 - RNA, 19 nt, Artificial Sequence
  Synthetic Oligonucleotide
cuuuggcagcaaaaugucu

SEQ ID NO: 4691 - RNA, 19 nt, Artificial Sequence
  Synthetic Oligonucleotide
uuggcagcaaaaugucuua

SEQ ID NO: 4692 - RNA, 19 nt, Artificial Sequence
  Synthetic Oligonucleotide
ggcagcaaaaugucuuacu

SEQ ID NO: 4693 - RNA, 19 nt, Artificial Sequence
  Synthetic Oligonucleotide
cagcaaaaugucuuacugg

SEQ ID NO: 4694 - RNA, 19 nt, Artificial Sequence
  Synthetic Oligonucleotide
aagaaauuuggacaauaug

SEQ ID NO: 4695 - RNA, 19 nt, Artificial Sequence
  Synthetic Oligonucleotide
gaaauuuggacaauaugca

SEQ ID NO: 4696 - RNA, 19 nt, Artificial Sequence
  Synthetic Oligonucleotide
aauuuggacaauaugcagg

SEQ ID NO: 4697 - RNA, 19 nt, Artificial Sequence
  Synthetic Oligonucleotide
uuuggacaauaugcaggac

SEQ ID NO: 4698 - RNA, 19 nt, Artificial Sequence
  Synthetic Oligonucleotide
uggacaauaugcaggacau

SEQ ID NO: 4699 - RNA, 19 nt, Artificial Sequence
  Synthetic Oligonucleotide
gacaauaugcaggacaugu

SEQ ID NO: 4700 - RNA, 19 nt, Artificial Sequence
  Synthetic Oligonucleotide
caauaugcaggacauguug

SEQ ID NO: 4701 - RNA, 19 nt, Artificial Sequence
  Synthetic Oligonucleotide
auaugcaggacauguugug

SEQ ID NO: 4702 - RNA, 19 nt, Artificial Sequence
  Synthetic Oligonucleotide
augcaggacauguugugcc

SEQ ID NO: 4703 - RNA, 19 nt, Artificial Sequence
  Synthetic Oligonucleotide
gcaggacauguugugccaa

SEQ ID NO: 4704 - RNA, 19 nt, Artificial Sequence
  Synthetic Oligonucleotide
ccucaagugguacaagccc

SEQ ID NO: 4705 - RNA, 19 nt, Artificial Sequence
  Synthetic Oligonucleotide
ucaagugguacaagcccug

SEQ ID NO: 4706 - RNA, 19 nt, Artificial Sequence
  Synthetic Oligonucleotide
aagugguacaagcccugca

SEQ ID NO: 4707 - RNA, 19 nt, Artificial Sequence
  Synthetic Oligonucleotide
gugguacaagcccugcagg

SEQ ID NO: 4708 - RNA, 19 nt, Artificial Sequence
  Synthetic Oligonucleotide
gguacaagcccugcaggag

SEQ ID NO: 4709 - RNA, 19 nt, Artificial Sequence
  Synthetic Oligonucleotide
uacaagcccugcaggaggc

SEQ ID NO: 4710 - RNA, 19 nt, Artificial Sequence
  Synthetic Oligonucleotide
caagcccugcaggaggcaa

SEQ ID NO: 4711 - RNA, 19 nt, Artificial Sequence
  Synthetic Oligonucleotide
agcccugcaggaggcaauu

SEQ ID NO: 4712 - RNA, 19 nt, Artificial Sequence
  Synthetic Oligonucleotide
cccugcaggaggcaauuga

SEQ ID NO: 4713 - RNA, 19 nt, Artificial Sequence
  Synthetic Oligonucleotide
cugcaggaggcaauugaug

SEQ ID NO: 4714 - RNA, 19 nt, Artificial Sequence
  Synthetic Oligonucleotide
gcaggaggcaauugaugca

SEQ ID NO: 4715 - RNA, 19 nt, Artificial Sequence
  Synthetic Oligonucleotide
aggaggcaauugaugcaau

SEQ ID NO: 4716 - RNA, 19 nt, Artificial Sequence
  Synthetic Oligonucleotide
gaggcaauugaugcaaucu

SEQ ID NO: 4717 - RNA, 19 nt, Artificial Sequence
  Synthetic Oligonucleotide
ggcaauugaugcaaucuuc

SEQ ID NO: 4718 - RNA, 19 nt, Artificial Sequence
  Synthetic Oligonucleotide
uacuaccacacuacagaac

SEQ ID NO: 4719 - RNA, 19 nt, Artificial Sequence
  Synthetic Oligonucleotide
cuaccacacuacagaacau

SEQ ID NO: 4720 - RNA, 19 nt, Artificial Sequence
  Synthetic Oligonucleotide
accacacuacagaacauca

SEQ ID NO: 4721 - RNA, 19 nt, Artificial Sequence
  Synthetic Oligonucleotide
cacacuacagaacaucagu

SEQ ID NO: 4722 - RNA, 19 nt, Artificial Sequence
  Synthetic Oligonucleotide
cacuacagaacaucaguga

SEQ ID NO: 4723 - RNA, 19 nt, Artificial Sequence
  Synthetic Oligonucleotide
cuacagaacaucagugagg

SEQ ID NO: 4724 - RNA, 19 nt, Artificial Sequence
  Synthetic Oligonucleotide
acagaacaucagugaggau

SEQ ID NO: 4725 - RNA, 19 nt, Artificial Sequence
  Synthetic Oligonucleotide
uuuagcaguaauggauaau

SEQ ID NO: 4726 - RNA, 19 nt, Artificial Sequence
  Synthetic Oligonucleotide
uagcaguaauggauaauaa

SEQ ID NO: 4727 - RNA, 19 nt, Artificial Sequence
  Synthetic Oligonucleotide
gcaguaauggauaauaaaa

SEQ ID NO: 4728 - RNA, 19 nt, Artificial Sequence
  Synthetic Oligonucleotide
aguaauggauaauaaaaau

SEQ ID NO: 4729 - RNA, 19 nt, Artificial Sequence
  Synthetic Oligonucleotide
aaccaucaagcagcagaca

SEQ ID NO: 4730 - RNA, 19 nt, Artificial Sequence
  Synthetic Oligonucleotide
acuacuuaagcacaucaau

SEQ ID NO: 4731 - RNA, 19 nt, Artificial Sequence
  Synthetic Oligonucleotide
uacuuaagcacaucaauga

SEQ ID NO: 4732 - RNA, 19 nt, Artificial Sequence
  Synthetic Oligonucleotide
cuuaagcacaucaaugauu

SEQ ID NO: 4733 - RNA, 19 nt, Artificial Sequence
  Synthetic Oligonucleotide
uaagcacaucaaugauucu

SEQ ID NO: 4734 - RNA, 19 nt, Artificial Sequence
  Synthetic Oligonucleotide
agcacaucaaugauucugc

SEQ ID NO: 4735 - RNA, 19 nt, Artificial Sequence
  Synthetic Oligonucleotide
cacaucaaugauucugcuc

SEQ ID NO: 4736 - RNA, 19 nt, Artificial Sequence
  Synthetic Oligonucleotide
caucaaugauucugcuccu

SEQ ID NO: 4737 - RNA, 19 nt, Artificial Sequence
  Synthetic Oligonucleotide
ucaaugauucugcuccuga

SEQ ID NO: 4738 - RNA, 19 nt, Artificial Sequence
  Synthetic Oligonucleotide
aaugauucugcuccugaag

SEQ ID NO: 4739 - RNA, 19 nt, Artificial Sequence
  Synthetic Oligonucleotide
ugauucugcuccugaaguc

SEQ ID NO: 4740 - RNA, 19 nt, Artificial Sequence
  Synthetic Oligonucleotide
auucugcuccugaagucag

SEQ ID NO: 4741 - RNA, 19 nt, Artificial Sequence
  Synthetic Oligonucleotide
ucugcuccugaagucagag

SEQ ID NO: 4742 - RNA, 19 nt, Artificial Sequence
  Synthetic Oligonucleotide
ugcuccugaagucagagau

SEQ ID NO: 4743 - RNA, 19 nt, Artificial Sequence
  Synthetic Oligonucleotide
agaucaaagaauguucaga

SEQ ID NO: 4744 - RNA, 19 nt, Artificial Sequence
  Synthetic Oligonucleotide
aucaaagaauguucagaaa

SEQ ID NO: 4745 - RNA, 19 nt, Artificial Sequence
  Synthetic Oligonucleotide
aaaccuggauggaaagaaa

SEQ ID NO: 4746 - RNA, 19 nt, Artificial Sequence
  Synthetic Oligonucleotide
accuggauggaaagaaacu

SEQ ID NO: 4747 - RNA, 19 nt, Artificial Sequence
  Synthetic Oligonucleotide
cuggauggaaagaaacuaa

SEQ ID NO: 4748 - RNA, 19 nt, Artificial Sequence
  Synthetic Oligonucleotide
ggauggaaagaaacuaauu

SEQ ID NO: 4749 - RNA, 19 nt, Artificial Sequence
  Synthetic Oligonucleotide
auggaaagaaacuaauuuu

SEQ ID NO: 4750 - RNA, 19 nt, Artificial Sequence
  Synthetic Oligonucleotide
ggaaagaaacuaauuuuca

SEQ ID NO: 4751 - RNA, 19 nt, Artificial Sequence
  Synthetic Oligonucleotide
aaagaaacuaauuuucagg

SEQ ID NO: 4752 - RNA, 19 nt, Artificial Sequence
  Synthetic Oligonucleotide
agaaacuaauuuucaggug

SEQ ID NO: 4753 - RNA, 19 nt, Artificial Sequence
  Synthetic Oligonucleotide
aaacuaauuuucaggugau

SEQ ID NO: 4754 - RNA, 19 nt, Artificial Sequence
  Synthetic Oligonucleotide
acuaauuuucaggugaugc

SEQ ID NO: 4755 - RNA, 19 nt, Artificial Sequence
  Synthetic Oligonucleotide
guugcuuugauugcccaga

SEQ ID NO: 4756 - RNA, 19 nt, Artificial Sequence
  Synthetic Oligonucleotide
ugcuuugauugcccagaag

SEQ ID NO: 4757 - RNA, 19 nt, Artificial Sequence
  Synthetic Oligonucleotide
cuuugauugcccagaaggg

SEQ ID NO: 4758 - RNA, 19 nt, Artificial Sequence
  Synthetic Oligonucleotide
uugauugcccagaagggaa

SEQ ID NO: 4759 - RNA, 19 nt, Artificial Sequence
  Synthetic Oligonucleotide
gauugcccagaagggaaau

SEQ ID NO: 4760 - RNA, 19 nt, Artificial Sequence
  Synthetic Oligonucleotide
uugcccagaagggaaauuu

SEQ ID NO: 4761 - RNA, 19 nt, Artificial Sequence
  Synthetic Oligonucleotide
gcccagaagggaaauuuuu

SEQ ID NO: 4762 - RNA, 19 nt, Artificial Sequence
  Synthetic Oligonucleotide
ggacaagauuggagaugug

SEQ ID NO: 4763 - RNA, 19 nt, Artificial Sequence
  Synthetic Oligonucleotide
acaagauuggagaugugaa

SEQ ID NO: 4764 - RNA, 19 nt, Artificial Sequence
  Synthetic Oligonucleotide
aagauuggagaugugaaau

SEQ ID NO: 4765 - RNA, 19 nt, Artificial Sequence
  Synthetic Oligonucleotide
gauuggagaugugaaaugu

SEQ ID NO: 4766 - RNA, 19 nt, Artificial Sequence
  Synthetic Oligonucleotide
uuggagaugugaaaugugg

SEQ ID NO: 4767 - RNA, 19 nt, Artificial Sequence
  Synthetic Oligonucleotide
ggagaugugaaauguggga

SEQ ID NO: 4768 - RNA, 19 nt, Artificial Sequence
  Synthetic Oligonucleotide
agaugugaaaugugggaac

SEQ ID NO: 4769 - RNA, 19 nt, Artificial Sequence
  Synthetic Oligonucleotide
augugaaaugugggaacaa

SEQ ID NO: 4770 - RNA, 19 nt, Artificial Sequence
  Synthetic Oligonucleotide
gugaaaugugggaacaaug

SEQ ID NO: 4771 - RNA, 19 nt, Artificial Sequence
  Synthetic Oligonucleotide
gaaaugugggaacaaugca

SEQ ID NO: 4772 - RNA, 19 nt, Artificial Sequence
  Synthetic Oligonucleotide
aaugugggaacaaugcaaa

SEQ ID NO: 4773 - RNA, 19 nt, Artificial Sequence
  Synthetic Oligonucleotide
ugugggaacaaugcaaaag

SEQ ID NO: 4774 - RNA, 19 nt, Artificial Sequence
  Synthetic Oligonucleotide
ugggaacaaugcaaaagaa

SEQ ID NO: 4775 - RNA, 19 nt, Artificial Sequence
  Synthetic Oligonucleotide
gguugaaugucaaagcuuu

SEQ ID NO: 4776 - RNA, 19 nt, Artificial Sequence
  Synthetic Oligonucleotide
uugaaugucaaagcuuuca

SEQ ID NO: 4777 - RNA, 19 nt, Artificial Sequence
  Synthetic Oligonucleotide
gaaugucaaagcuuucauu

SEQ ID NO: 4778 - RNA, 19 nt, Artificial Sequence
  Synthetic Oligonucleotide
augucaaagcuuucauuag

SEQ ID NO: 4779 - RNA, 19 nt, Artificial Sequence
  Synthetic Oligonucleotide
gucaaagcuuucauuagca

SEQ ID NO: 4780 - RNA, 19 nt, Artificial Sequence
  Synthetic Oligonucleotide
acccugcuuggcgugaugu

SEQ ID NO: 4781 - RNA, 19 nt, Artificial Sequence
  Synthetic Oligonucleotide
ccugcuuggcgugauguau

SEQ ID NO: 4782 - RNA, 19 nt, Artificial Sequence
  Synthetic Oligonucleotide
uucuuugaggaugagaagc

SEQ ID NO: 4783 - RNA, 19 nt, Artificial Sequence
  Synthetic Oligonucleotide
cuuugaggaugagaagccu

SEQ ID NO: 4784 - RNA, 19 nt, Artificial Sequence
  Synthetic Oligonucleotide
uugaggaugagaagccugc

SEQ ID NO: 4785 - RNA, 19 nt, Artificial Sequence
  Synthetic Oligonucleotide
gaggaugagaagccugccc

SEQ ID NO: 4786 - RNA, 19 nt, Artificial Sequence
  Synthetic Oligonucleotide
ggaugagaagccugcccuc

SEQ ID NO: 4787 - RNA, 19 nt, Artificial Sequence
  Synthetic Oligonucleotide
augagaagccugcccuccu

SEQ ID NO: 4788 - RNA, 19 nt, Artificial Sequence
  Synthetic Oligonucleotide
gagaagccugcccuccuau

SEQ ID NO: 4789 - RNA, 19 nt, Artificial Sequence
  Synthetic Oligonucleotide
gaagccugcccuccuaucc

SEQ ID NO: 4790 - RNA, 19 nt, Artificial Sequence
  Synthetic Oligonucleotide
agccugcccuccuauccca

SEQ ID NO: 4791 - RNA, 19 nt, Artificial Sequence
  Synthetic Oligonucleotide
ccugcccuccuaucccaga

SEQ ID NO: 4792 - RNA, 19 nt, Artificial Sequence
  Synthetic Oligonucleotide
ugcccuccuaucccagaua

SEQ ID NO: 4793 - RNA, 19 nt, Artificial Sequence
  Synthetic Oligonucleotide
cccuccuaucccagauaga

SEQ ID NO: 4794 - RNA, 19 nt, Artificial Sequence
  Synthetic Oligonucleotide
cuccuaucccagauagaug

SEQ ID NO: 4795 - RNA, 19 nt, Artificial Sequence
  Synthetic Oligonucleotide
ccuaucccagauagaugca

SEQ ID NO: 4796 - RNA, 19 nt, Artificial Sequence
  Synthetic Oligonucleotide
uaucccagauagaugcaga

SEQ ID NO: 4797 - RNA, 19 nt, Artificial Sequence
  Synthetic Oligonucleotide
ucccagauagaugcagaau

SEQ ID NO: 4798 - RNA, 19 nt, Artificial Sequence
  Synthetic Oligonucleotide
gaagaugcagggacaaagu

SEQ ID NO: 4799 - RNA, 19 nt, Artificial Sequence
  Synthetic Oligonucleotide
guacagaugaaggagaaga

SEQ ID NO: 4800 - RNA, 19 nt, Artificial Sequence
  Synthetic Oligonucleotide
acagaugaaggagaagaug

SEQ ID NO: 4801 - RNA, 19 nt, Artificial Sequence
  Synthetic Oligonucleotide
agaugaaggagaagaugga

SEQ ID NO: 4802 - RNA, 19 nt, Artificial Sequence
  Synthetic Oligonucleotide
cguugaucuuuugccgagg

SEQ ID NO: 4803 - RNA, 19 nt, Artificial Sequence
  Synthetic Oligonucleotide
aggaaagaaggccuagaug

SEQ ID NO: 4804 - RNA, 19 nt, Artificial Sequence
  Synthetic Oligonucleotide
gaaagaaggccuagaugaa

SEQ ID NO: 4805 - RNA, 19 nt, Artificial Sequence
  Synthetic Oligonucleotide
aagaaggccuagaugaagu

SEQ ID NO: 4806 - RNA, 19 nt, Artificial Sequence
  Synthetic Oligonucleotide
gaaggccuagaugaagugg

SEQ ID NO: 4807 - RNA, 19 nt, Artificial Sequence
  Synthetic Oligonucleotide
aggccuagaugaaguggca

SEQ ID NO: 4808 - RNA, 19 nt, Artificial Sequence
  Synthetic Oligonucleotide
gccuagaugaaguggcagg

SEQ ID NO: 4809 - RNA, 19 nt, Artificial Sequence
  Synthetic Oligonucleotide
cuagaugaaguggcaggua

SEQ ID NO: 4810 - RNA, 19 nt, Artificial Sequence
  Synthetic Oligonucleotide
agaugaaguggcagguauu

SEQ ID NO: 4811 - RNA, 19 nt, Artificial Sequence
  Synthetic Oligonucleotide
gaauauaggugaacuucca

SEQ ID NO: 4812 - RNA, 19 nt, Artificial Sequence
  Synthetic Oligonucleotide
auauaggugaacuuccaac

SEQ ID NO: 4813 - RNA, 19 nt, Artificial Sequence
  Synthetic Oligonucleotide
auaggugaacuuccaacug

SEQ ID NO: 4814 - RNA, 19 nt, Artificial Sequence
  Synthetic Oligonucleotide
aggugaacuuccaacugcc

SEQ ID NO: 4815 - RNA, 19 nt, Artificial Sequence
  Synthetic Oligonucleotide
gugaacuuccaacugccuu

SEQ ID NO: 4816 - RNA, 19 nt, Artificial Sequence
  Synthetic Oligonucleotide
gaacuuccaacugccuuga

SEQ ID NO: 4817 - RNA, 19 nt, Artificial Sequence
  Synthetic Oligonucleotide
acuuccaacugccuugaag

SEQ ID NO: 4818 - RNA, 19 nt, Artificial Sequence
  Synthetic Oligonucleotide
uuccaacugccuugaaggg

SEQ ID NO: 4819 - RNA, 19 nt, Artificial Sequence
  Synthetic Oligonucleotide
ccaacugccuugaaggguc

SEQ ID NO: 4820 - RNA, 19 nt, Artificial Sequence
  Synthetic Oligonucleotide
aacugccuugaagggucga

SEQ ID NO: 4821 - RNA, 19 nt, Artificial Sequence
  Synthetic Oligonucleotide
acaacuggcaguagccaug

SEQ ID NO: 4822 - RNA, 19 nt, Artificial Sequence
  Synthetic Oligonucleotide
cagcaagaacaauguucga

SEQ ID NO: 4823 - RNA, 19 nt, Artificial Sequence
  Synthetic Oligonucleotide
gcaagaacaauguucgagc

SEQ ID NO: 4824 - RNA, 19 nt, Artificial Sequence
  Synthetic Oligonucleotide
aagaacaauguucgagcug

SEQ ID NO: 4825 - RNA, 19 nt, Artificial Sequence
  Synthetic Oligonucleotide
gaacaauguucgagcugcu

SEQ ID NO: 4826 - RNA, 19 nt, Artificial Sequence
  Synthetic Oligonucleotide
acaauguucgagcugcugc

SEQ ID NO: 4827 - RNA, 19 nt, Artificial Sequence
  Synthetic Oligonucleotide
aauguucgagcugcugccc

SEQ ID NO: 4828 - RNA, 19 nt, Artificial Sequence
  Synthetic Oligonucleotide
uguucgagcugcugcccua

SEQ ID NO: 4829 - RNA, 19 nt, Artificial Sequence
  Synthetic Oligonucleotide
gacugugaaugcuugggca

SEQ ID NO: 4830 - RNA, 19 nt, Artificial Sequence
  Synthetic Oligonucleotide
cugugaaugcuugggcaga

SEQ ID NO: 4831 - RNA, 19 nt, Artificial Sequence
  Synthetic Oligonucleotide
gugaaugcuugggcagaac

SEQ ID NO: 4832 - RNA, 19 nt, Artificial Sequence
  Synthetic Oligonucleotide
ggagaagaucuuucugaag

SEQ ID NO: 4833 - RNA, 19 nt, Artificial Sequence
  Synthetic Oligonucleotide
ccuagaagaucgaaaugga

SEQ ID NO: 4834 - RNA, 19 nt, Artificial Sequence
  Synthetic Oligonucleotide
uagaagaucgaaauggaga

SEQ ID NO: 4835 - RNA, 19 nt, Artificial Sequence
  Synthetic Oligonucleotide
gaagaucgaaauggagaug

SEQ ID NO: 4836 - RNA, 19 nt, Artificial Sequence
  Synthetic Oligonucleotide
augaugcauuuaggauaug

SEQ ID NO: 4837 - RNA, 19 nt, Artificial Sequence
  Synthetic Oligonucleotide
gaugcauuuaggauaugaa

SEQ ID NO: 4838 - RNA, 19 nt, Artificial Sequence
  Synthetic Oligonucleotide
ugcauuuaggauaugaaaa

SEQ ID NO: 4839 - RNA, 19 nt, Artificial Sequence
  Synthetic Oligonucleotide
cauuuaggauaugaaaaaa

SEQ ID NO: 4840 - RNA, 19 nt, Artificial Sequence
  Synthetic Oligonucleotide
uuuaggauaugaaaaaaug

SEQ ID NO: 4841 - RNA, 19 nt, Artificial Sequence
  Synthetic Oligonucleotide
caaggcuacugggaaacua

SEQ ID NO: 4842 - RNA, 19 nt, Artificial Sequence
  Synthetic Oligonucleotide
aggcuacugggaaacuaaa

SEQ ID NO: 4843 - RNA, 19 nt, Artificial Sequence
  Synthetic Oligonucleotide
gcuacugggaaacuaaagc

SEQ ID NO: 4844 - RNA, 19 nt, Artificial Sequence
  Synthetic Oligonucleotide
uacugggaaacuaaagcca

SEQ ID NO: 4845 - RNA, 19 nt, Artificial Sequence
  Synthetic Oligonucleotide
cugggaaacuaaagccaac

SEQ ID NO: 4846 - RNA, 19 nt, Artificial Sequence
  Synthetic Oligonucleotide
gggaaacuaaagccaacuu

SEQ ID NO: 4847 - RNA, 19 nt, Artificial Sequence
  Synthetic Oligonucleotide
gaaacuaaagccaacuucu

SEQ ID NO: 4848 - RNA, 19 nt, Artificial Sequence
  Synthetic Oligonucleotide
aacuaaagccaacuucuaa

SEQ ID NO: 4849 - RNA, 19 nt, Artificial Sequence
  Synthetic Oligonucleotide
cuaaagccaacuucuaaag

SEQ ID NO: 4850 - RNA, 19 nt, Artificial Sequence
  Synthetic Oligonucleotide
aaagccaacuucuaaagau

SEQ ID NO: 4851 - RNA, 19 nt, Artificial Sequence
  Synthetic Oligonucleotide
gccuauuuuuauuguuguu

SEQ ID NO: 4852 - RNA, 19 nt, Artificial Sequence
  Synthetic Oligonucleotide
cuauuuuuauuguuguucc

SEQ ID NO: 4853 - RNA, 19 nt, Artificial Sequence
  Synthetic Oligonucleotide
auuuuuauuguuguuccaa

SEQ ID NO: 4854 - RNA, 19 nt, Artificial Sequence
  Synthetic Oligonucleotide
uuuuauuguuguuccaaau

SEQ ID NO: 4855 - RNA, 19 nt, Artificial Sequence
  Synthetic Oligonucleotide
uuauuguuguuccaaaugg

SEQ ID NO: 4856 - RNA, 19 nt, Artificial Sequence
  Synthetic Oligonucleotide
auuguuguuccaaauggaa

SEQ ID NO: 4857 - RNA, 19 nt, Artificial Sequence
  Synthetic Oligonucleotide
aaggugcuaaaguggaauu

SEQ ID NO: 4858 - RNA, 19 nt, Artificial Sequence
  Synthetic Oligonucleotide
ggugcuaaaguggaauuuu

SEQ ID NO: 4859 - RNA, 19 nt, Artificial Sequence
  Synthetic Oligonucleotide
uaucaucuuacugagaaug

SEQ ID NO: 4860 - RNA, 19 nt, Artificial Sequence
  Synthetic Oligonucleotide
ucaucuuacugagaaugaa

SEQ ID NO: 4861 - RNA, 19 nt, Artificial Sequence
  Synthetic Oligonucleotide
aucuuacugagaaugaagc

SEQ ID NO: 4862 - RNA, 19 nt, Artificial Sequence
  Synthetic Oligonucleotide
cuuacugagaaugaagcau

SEQ ID NO: 4863 - RNA, 19 nt, Artificial Sequence
  Synthetic Oligonucleotide
ucaagguuggagaaccaaa

SEQ ID NO: 4864 - RNA, 19 nt, Artificial Sequence
  Synthetic Oligonucleotide
aagguuggagaaccaaagg

SEQ ID NO: 4865 - RNA, 19 nt, Artificial Sequence
  Synthetic Oligonucleotide
gguuggagaaccaaaggau

SEQ ID NO: 4866 - RNA, 19 nt, Artificial Sequence
  Synthetic Oligonucleotide
uuggagaaccaaaggaugu

SEQ ID NO: 4867 - RNA, 19 nt, Artificial Sequence
  Synthetic Oligonucleotide
ggagaaccaaaggauguca

SEQ ID NO: 4868 - RNA, 19 nt, Artificial Sequence
  Synthetic Oligonucleotide
agaaccaaaggaugucauu

SEQ ID NO: 4869 - RNA, 19 nt, Artificial Sequence
  Synthetic Oligonucleotide
aaccaaaggaugucauucg

SEQ ID NO: 4870 - RNA, 19 nt, Artificial Sequence
  Synthetic Oligonucleotide
ccaaaggaugucauucgua

SEQ ID NO: 4871 - RNA, 19 nt, Artificial Sequence
  Synthetic Oligonucleotide
aaaggaugucauucguaaa

SEQ ID NO: 4872 - RNA, 19 nt, Artificial Sequence
  Synthetic Oligonucleotide
aggaugucauucguaaaga

SEQ ID NO: 4873 - RNA, 19 nt, Artificial Sequence
  Synthetic Oligonucleotide
gaugucauucguaaagaug

SEQ ID NO: 4874 - RNA, 19 nt, Artificial Sequence
  Synthetic Oligonucleotide
auccugaaccggaugugcc

SEQ ID NO: 4875 - RNA, 19 nt, Artificial Sequence
  Synthetic Oligonucleotide
ccugaaccggaugugccuu

SEQ ID NO: 4876 - RNA, 19 nt, Artificial Sequence
  Synthetic Oligonucleotide
ugaaccggaugugccuugu

SEQ ID NO: 4877 - RNA, 19 nt, Artificial Sequence
  Synthetic Oligonucleotide
aaccggaugugccuugucu

SEQ ID NO: 4878 - RNA, 19 nt, Artificial Sequence
  Synthetic Oligonucleotide
ccggaugugccuugucuac

SEQ ID NO: 4879 - RNA, 19 nt, Artificial Sequence
  Synthetic Oligonucleotide
ggaugugccuugucuaccc

SEQ ID NO: 4880 - RNA, 19 nt, Artificial Sequence
  Synthetic Oligonucleotide
augugccuugucuacccag

SEQ ID NO: 4881 - RNA, 19 nt, Artificial Sequence
  Synthetic Oligonucleotide
uccaaaaacucuaagcaga

SEQ ID NO: 4882 - RNA, 19 nt, Artificial Sequence
  Synthetic Oligonucleotide
caaaaacucuaagcagaga

SEQ ID NO: 4883 - RNA, 19 nt, Artificial Sequence
  Synthetic Oligonucleotide
aaaacucuaagcagagagc

SEQ ID NO: 4884 - RNA, 19 nt, Artificial Sequence
  Synthetic Oligonucleotide
aacucuaagcagagagcag

SEQ ID NO: 4885 - RNA, 19 nt, Artificial Sequence
  Synthetic Oligonucleotide
cucuaagcagagagcagag

SEQ ID NO: 4886 - RNA, 19 nt, Artificial Sequence
  Synthetic Oligonucleotide
cuaagcagagagcagagug

SEQ ID NO: 4887 - RNA, 19 nt, Artificial Sequence
  Synthetic Oligonucleotide
aagcagagagcagagugcc

SEQ ID NO: 4888 - RNA, 19 nt, Artificial Sequence
  Synthetic Oligonucleotide
gcagagagcagagugccug

SEQ ID NO: 4889 - RNA, 19 nt, Artificial Sequence
  Synthetic Oligonucleotide
agagagcagagugccugga

SEQ ID NO: 4890 - RNA, 19 nt, Artificial Sequence
  Synthetic Oligonucleotide
agagcagagugccuggaag

SEQ ID NO: 4891 - RNA, 19 nt, Artificial Sequence
  Synthetic Oligonucleotide
agcagagugccuggaagag

SEQ ID NO: 4892 - RNA, 19 nt, Artificial Sequence
  Synthetic Oligonucleotide
ccaggaaaagccuuaaagg

SEQ ID NO: 4893 - RNA, 19 nt, Artificial Sequence
  Synthetic Oligonucleotide
gaucagguguucaaacuga

SEQ ID NO: 4894 - RNA, 19 nt, Artificial Sequence
  Synthetic Oligonucleotide
ucagguguucaaacugauu

SEQ ID NO: 4895 - RNA, 19 nt, Artificial Sequence
  Synthetic Oligonucleotide
agguguucaaacugauugg

SEQ ID NO: 4896 - RNA, 19 nt, Artificial Sequence
  Synthetic Oligonucleotide
guguucaaacugauuggaa

SEQ ID NO: 4897 - RNA, 19 nt, Artificial Sequence
  Synthetic Oligonucleotide
guucaaacugauuggaaau

SEQ ID NO: 4898 - RNA, 19 nt, Artificial Sequence
  Synthetic Oligonucleotide
ucaaacugauuggaaaucu

SEQ ID NO: 4899 - RNA, 19 nt, Artificial Sequence
  Synthetic Oligonucleotide
aaacugauuggaaaucuuu

SEQ ID NO: 4900 - RNA, 19 nt, Artificial Sequence
  Synthetic Oligonucleotide
acugauuggaaaucuuucu

SEQ ID NO: 4901 - RNA, 19 nt, Artificial Sequence
  Synthetic Oligonucleotide
uaagcggucagcaaagaga

SEQ ID NO: 4902 - RNA, 19 nt, Artificial Sequence
  Synthetic Oligonucleotide
agcggucagcaaagagacc

SEQ ID NO: 4903 - RNA, 19 nt, Artificial Sequence
  Synthetic Oligonucleotide
cggucagcaaagagacccu

SEQ ID NO: 4904 - RNA, 19 nt, Artificial Sequence
  Synthetic Oligonucleotide
gucagcaaagagacccucu

SEQ ID NO: 4905 - RNA, 19 nt, Artificial Sequence
  Synthetic Oligonucleotide
cagcaaagagacccucugc

SEQ ID NO: 4906 - RNA, 19 nt, Artificial Sequence
  Synthetic Oligonucleotide
gcaaagagacccucugcug

SEQ ID NO: 4907 - RNA, 19 nt, Artificial Sequence
  Synthetic Oligonucleotide
aaagagacccucugcugca

SEQ ID NO: 4908 - RNA, 19 nt, Artificial Sequence
  Synthetic Oligonucleotide
uuacgcaagggaccagcug

SEQ ID NO: 4909 - RNA, 19 nt, Artificial Sequence
  Synthetic Oligonucleotide
acgcaagggaccagcugag

SEQ ID NO: 4910 - RNA, 19 nt, Artificial Sequence
  Synthetic Oligonucleotide
ccgccgagaauuccagcug

SEQ ID NO: 4911 - RNA, 19 nt, Artificial Sequence
  Synthetic Oligonucleotide
gccgagaauuccagcugga

SEQ ID NO: 4912 - RNA, 19 nt, Artificial Sequence
  Synthetic Oligonucleotide
aagauccgggcuguuucuc

SEQ ID NO: 4913 - RNA, 19 nt, Artificial Sequence
  Synthetic Oligonucleotide
gauccgggcuguuucucca

SEQ ID NO: 4914 - RNA, 19 nt, Artificial Sequence
  Synthetic Oligonucleotide
cgaugacaugcacaguaau

SEQ ID NO: 4915 - RNA, 19 nt, Artificial Sequence
  Synthetic Oligonucleotide
augacaugcacaguaauac

SEQ ID NO: 4916 - RNA, 19 nt, Artificial Sequence
  Synthetic Oligonucleotide
gacaugcacaguaauacag

SEQ ID NO: 4917 - RNA, 19 nt, Artificial Sequence
  Synthetic Oligonucleotide
caugcacaguaauacagca

SEQ ID NO: 4918 - RNA, 19 nt, Artificial Sequence
  Synthetic Oligonucleotide
ugcacaguaauacagcauc

SEQ ID NO: 4919 - RNA, 19 nt, Artificial Sequence
  Synthetic Oligonucleotide
cacaguaauacagcaucca

SEQ ID NO: 4920 - RNA, 19 nt, Artificial Sequence
  Synthetic Oligonucleotide
caguaauacagcauccaca

SEQ ID NO: 4921 - RNA, 19 nt, Artificial Sequence
  Synthetic Oligonucleotide
guaauacagcauccacaau

SEQ ID NO: 4922 - RNA, 19 nt, Artificial Sequence
  Synthetic Oligonucleotide
aauacagcauccacaauca

SEQ ID NO: 4923 - RNA, 19 nt, Artificial Sequence
  Synthetic Oligonucleotide
uacagcauccacaaucaau

SEQ ID NO: 4924 - RNA, 19 nt, Artificial Sequence
  Synthetic Oligonucleotide
cagcauccacaaucaauuu

SEQ ID NO: 4925 - RNA, 19 nt, Artificial Sequence
  Synthetic Oligonucleotide
gcauccacaaucaauuuca

SEQ ID NO: 4926 - RNA, 19 nt, Artificial Sequence
  Synthetic Oligonucleotide
auccacaaucaauuucauu

SEQ ID NO: 4927 - RNA, 19 nt, Artificial Sequence
  Synthetic Oligonucleotide
ccacaaucaauuucauuau

SEQ ID NO: 4928 - RNA, 19 nt, Artificial Sequence
  Synthetic Oligonucleotide
acaaucaauuucauuaucu

SEQ ID NO: 4929 - RNA, 19 nt, Artificial Sequence
  Synthetic Oligonucleotide
aaucaauuucauuaucucc

SEQ ID NO: 4930 - RNA, 19 nt, Artificial Sequence
  Synthetic Oligonucleotide
ucaauuucauuaucuccca

SEQ ID NO: 4931 - RNA, 19 nt, Artificial Sequence
  Synthetic Oligonucleotide
aauuucauuaucucccaag

SEQ ID NO: 4932 - RNA, 19 nt, Artificial Sequence
  Synthetic Oligonucleotide
uuucauuaucucccaagua

SEQ ID NO: 4933 - RNA, 19 nt, Artificial Sequence
  Synthetic Oligonucleotide
ucauuaucucccaaguagc

SEQ ID NO: 4934 - RNA, 19 nt, Artificial Sequence
  Synthetic Oligonucleotide
auuaucucccaaguagcca

SEQ ID NO: 4935 - RNA, 19 nt, Artificial Sequence
  Synthetic Oligonucleotide
uaucucccaaguagccagu

SEQ ID NO: 4936 - RNA, 19 nt, Artificial Sequence
  Synthetic Oligonucleotide
ucucccaaguagccagugg

SEQ ID NO: 4937 - RNA, 19 nt, Artificial Sequence
  Synthetic Oligonucleotide
ucccaaguagccaguggug

SEQ ID NO: 4938 - RNA, 19 nt, Artificial Sequence
  Synthetic Oligonucleotide
ccaaguagccaguggugac

SEQ ID NO: 4939 - RNA, 19 nt, Artificial Sequence
  Synthetic Oligonucleotide
ugcccgggaggccuccacu

SEQ ID NO: 4940 - RNA, 19 nt, Artificial Sequence
  Synthetic Oligonucleotide
cccgggaggccuccacugg

SEQ ID NO: 4941 - RNA, 19 nt, Artificial Sequence
  Synthetic Oligonucleotide
cgggaggccuccacuggag

SEQ ID NO: 4942 - RNA, 19 nt, Artificial Sequence
  Synthetic Oligonucleotide
ggaggccuccacuggagua

SEQ ID NO: 4943 - RNA, 19 nt, Artificial Sequence
  Synthetic Oligonucleotide
caucaccuuaaugcuggau

SEQ ID NO: 4944 - RNA, 19 nt, Artificial Sequence
  Synthetic Oligonucleotide
ucaccuuaaugcuggauuc

SEQ ID NO: 4945 - RNA, 19 nt, Artificial Sequence
  Synthetic Oligonucleotide
accuuaaugcuggauucuc

SEQ ID NO: 4946 - RNA, 19 nt, Artificial Sequence
  Synthetic Oligonucleotide
cuuaaugcuggauucucgg

SEQ ID NO: 4947 - RNA, 19 nt, Artificial Sequence
  Synthetic Oligonucleotide
uaaugcuggauucucggau

SEQ ID NO: 4948 - RNA, 19 nt, Artificial Sequence
  Synthetic Oligonucleotide
augcuggauucucggauug

SEQ ID NO: 4949 - RNA, 19 nt, Artificial Sequence
  Synthetic Oligonucleotide
gcuggauucucggauugaa

SEQ ID NO: 4950 - RNA, 19 nt, Artificial Sequence
  Synthetic Oligonucleotide
uggauucucggauugaaga

SEQ ID NO: 4951 - RNA, 19 nt, Artificial Sequence
  Synthetic Oligonucleotide
gauucucggauugaagauc

SEQ ID NO: 4952 - RNA, 19 nt, Artificial Sequence
  Synthetic Oligonucleotide
ucugugaaccucuuggugg

SEQ ID NO: 4953 - RNA, 19 nt, Artificial Sequence
  Synthetic Oligonucleotide
ugugaaccucuugguggug

SEQ ID NO: 4954 - RNA, 19 nt, Artificial Sequence
  Synthetic Oligonucleotide
ugaaccucuugguggugaa

SEQ ID NO: 4955 - RNA, 19 nt, Artificial Sequence
  Synthetic Oligonucleotide
aaccucuugguggugaagg

SEQ ID NO: 4956 - RNA, 19 nt, Artificial Sequence
  Synthetic Oligonucleotide
agacagccugcuagcaaca

SEQ ID NO: 4957 - RNA, 19 nt, Artificial Sequence
  Synthetic Oligonucleotide
caguucucccaaauucuca

SEQ ID NO: 4958 - RNA, 19 nt, Artificial Sequence
  Synthetic Oligonucleotide
guucucccaaauucucaga

SEQ ID NO: 4959 - RNA, 19 nt, Artificial Sequence
  Synthetic Oligonucleotide
ucucccaaauucucagagc

SEQ ID NO: 4960 - RNA, 19 nt, Artificial Sequence
  Synthetic Oligonucleotide
ucccaaauucucagagcuu

SEQ ID NO: 4961 - RNA, 19 nt, Artificial Sequence
  Synthetic Oligonucleotide
ccaaauucucagagcuugu

SEQ ID NO: 4962 - RNA, 19 nt, Artificial Sequence
  Synthetic Oligonucleotide
aaauucucagagcuuguua

SEQ ID NO: 4963 - RNA, 19 nt, Artificial Sequence
  Synthetic Oligonucleotide
auucucagagcuuguuaug

SEQ ID NO: 4964 - RNA, 19 nt, Artificial Sequence
  Synthetic Oligonucleotide
ucucagagcuuguuaugaa

SEQ ID NO: 4965 - RNA, 19 nt, Artificial Sequence
  Synthetic Oligonucleotide
ucagagcuuguuaugaagu

SEQ ID NO: 4966 - RNA, 19 nt, Artificial Sequence
  Synthetic Oligonucleotide
agagcuuguuaugaagugu

SEQ ID NO: 4967 - RNA, 19 nt, Artificial Sequence
  Synthetic Oligonucleotide
uagcauuaaccuagacaga

SEQ ID NO: 4968 - RNA, 19 nt, Artificial Sequence
  Synthetic Oligonucleotide
gcauuaaccuagacagaau

SEQ ID NO: 4969 - RNA, 19 nt, Artificial Sequence
  Synthetic Oligonucleotide
auuaaccuagacagaauuc

SEQ ID NO: 4970 - RNA, 19 nt, Artificial Sequence
  Synthetic Oligonucleotide
uaaccuagacagaauucuu

SEQ ID NO: 4971 - RNA, 19 nt, Artificial Sequence
  Synthetic Oligonucleotide
accuagacagaauucuucu

SEQ ID NO: 4972 - RNA, 19 nt, Artificial Sequence
  Synthetic Oligonucleotide
cuagacagaauucuucugg

SEQ ID NO: 4973 - RNA, 19 nt, Artificial Sequence
  Synthetic Oligonucleotide
auccacauuuucaugaagg

SEQ ID NO: 4974 - RNA, 19 nt, Artificial Sequence
  Synthetic Oligonucleotide
ugaagcaaugcaaaaguga

SEQ ID NO: 4975 - RNA, 19 nt, Artificial Sequence
  Synthetic Oligonucleotide
aagcaaugcaaaagugaau

SEQ ID NO: 4976 - RNA, 19 nt, Artificial Sequence
  Synthetic Oligonucleotide
gcaaugcaaaagugaauuu

SEQ ID NO: 4977 - RNA, 19 nt, Artificial Sequence
  Synthetic Oligonucleotide
caguauggaccagacuggg

SEQ ID NO: 4978 - RNA, 19 nt, Artificial Sequence
  Synthetic Oligonucleotide
guauggaccagacugggag

SEQ ID NO: 4979 - RNA, 19 nt, Artificial Sequence
  Synthetic Oligonucleotide
auggaccagacugggagca

SEQ ID NO: 4980 - RNA, 19 nt, Artificial Sequence
  Synthetic Oligonucleotide
ggaccagacugggagcaag

SEQ ID NO: 4981 - RNA, 19 nt, Artificial Sequence
  Synthetic Oligonucleotide
accagacugggagcaaguc

SEQ ID NO: 4982 - RNA, 19 nt, Artificial Sequence
  Synthetic Oligonucleotide
cagacugggagcaagucug

SEQ ID NO: 4983 - RNA, 19 nt, Artificial Sequence
  Synthetic Oligonucleotide
gacugggagcaagucugau

SEQ ID NO: 4984 - RNA, 19 nt, Artificial Sequence
  Synthetic Oligonucleotide
cugggagcaagucugauaa

SEQ ID NO: 4985 - RNA, 19 nt, Artificial Sequence
  Synthetic Oligonucleotide
gggagcaagucugauaagg

SEQ ID NO: 4986 - RNA, 19 nt, Artificial Sequence
  Synthetic Oligonucleotide
gagcaagucugauaaggaa

SEQ ID NO: 4987 - RNA, 19 nt, Artificial Sequence
  Synthetic Oligonucleotide
gcaagucugauaaggaaac

SEQ ID NO: 4988 - RNA, 19 nt, Artificial Sequence
  Synthetic Oligonucleotide
aagucugauaaggaaacag

SEQ ID NO: 4989 - RNA, 19 nt, Artificial Sequence
  Synthetic Oligonucleotide
gucugauaaggaaacagaa

SEQ ID NO: 4990 - RNA, 19 nt, Artificial Sequence
  Synthetic Oligonucleotide
cugauaaggaaacagaaaa

SEQ ID NO: 4991 - RNA, 19 nt, Artificial Sequence
  Synthetic Oligonucleotide
gauaaggaaacagaaaagg

SEQ ID NO: 4992 - RNA, 19 nt, Artificial Sequence
  Synthetic Oligonucleotide
uaaggaaacagaaaaggga

SEQ ID NO: 4993 - RNA, 19 nt, Artificial Sequence
  Synthetic Oligonucleotide
aucucgaauagaugaaaaa

SEQ ID NO: 4994 - RNA, 19 nt, Artificial Sequence
  Synthetic Oligonucleotide
cucgaauagaugaaaaauc

SEQ ID NO: 4995 - RNA, 19 nt, Artificial Sequence
  Synthetic Oligonucleotide
cgaauagaugaaaaaucau

SEQ ID NO: 4996 - RNA, 19 nt, Artificial Sequence
  Synthetic Oligonucleotide
aauagaugaaaaaucauca

SEQ ID NO: 4997 - RNA, 19 nt, Artificial Sequence
  Synthetic Oligonucleotide
uagaugaaaaaucaucaaa

SEQ ID NO: 4998 - RNA, 19 nt, Artificial Sequence
  Synthetic Oligonucleotide
gaugaaaaaucaucaaagg

SEQ ID NO: 4999 - RNA, 19 nt, Artificial Sequence
  Synthetic Oligonucleotide
ugaaaaaucaucaaaggcc

SEQ ID NO: 5000 - RNA, 19 nt, Artificial Sequence
  Synthetic Oligonucleotide
aaaaaucaucaaaggccaa

SEQ ID NO: 5001 - RNA, 19 nt, Artificial Sequence
  Synthetic Oligonucleotide
aaaucaucaaaggccaaag

SEQ ID NO: 5002 - RNA, 19 nt, Artificial Sequence
  Synthetic Oligonucleotide
aaugauuucuuagcugaga

SEQ ID NO: 5003 - RNA, 19 nt, Artificial Sequence
  Synthetic Oligonucleotide
ugauuucuuagcugagauu

SEQ ID NO: 5004 - RNA, 19 nt, Artificial Sequence
  Synthetic Oligonucleotide
auuucuuagcugagauuuu

SEQ ID NO: 5005 - RNA, 19 nt, Artificial Sequence
  Synthetic Oligonucleotide
uucuuagcugagauuuuua

SEQ ID NO: 5006 - RNA, 19 nt, Artificial Sequence
  Synthetic Oligonucleotide
cuuagcugagauuuuuaag

SEQ ID NO: 5007 - RNA, 19 nt, Artificial Sequence
  Synthetic Oligonucleotide
uagcugagauuuuuaagaa

SEQ ID NO: 5008 - RNA, 19 nt, Artificial Sequence
  Synthetic Oligonucleotide
gcugagauuuuuaagaaga

SEQ ID NO: 5009 - RNA, 19 nt, Artificial Sequence
  Synthetic Oligonucleotide
ugagauuuuuaagaagauu

SEQ ID NO: 5010 - RNA, 19 nt, Artificial Sequence
  Synthetic Oligonucleotide
agauuuuuaagaagauugg

SEQ ID NO: 5011 - RNA, 19 nt, Artificial Sequence
  Synthetic Oligonucleotide
auuuuuaagaagauuggcu

SEQ ID NO: 5012 - RNA, 19 nt, Artificial Sequence
  Synthetic Oligonucleotide
cuagcagaguuauaugaau

SEQ ID NO: 5013 - RNA, 19 nt, Artificial Sequence
  Synthetic Oligonucleotide
agcagaguuauaugaauau

SEQ ID NO: 5014 - RNA, 19 nt, Artificial Sequence
  Synthetic Oligonucleotide
cagaguuauaugaauauaa

SEQ ID NO: 5015 - RNA, 19 nt, Artificial Sequence
  Synthetic Oligonucleotide
gaguuauaugaauauaaga

SEQ ID NO: 5016 - RNA, 19 nt, Artificial Sequence
  Synthetic Oligonucleotide
guuauaugaauauaagaag

SEQ ID NO: 5017 - RNA, 19 nt, Artificial Sequence
  Synthetic Oligonucleotide
uauaugaauauaagaagaa

SEQ ID NO: 5018 - RNA, 19 nt, Artificial Sequence
  Synthetic Oligonucleotide
uaugaauauaagaagaaau

SEQ ID NO: 5019 - RNA, 19 nt, Artificial Sequence
  Synthetic Oligonucleotide
cugacauugaaccauuucu

SEQ ID NO: 5020 - RNA, 19 nt, Artificial Sequence
  Synthetic Oligonucleotide
gacauugaaccauuucuga

SEQ ID NO: 5021 - RNA, 19 nt, Artificial Sequence
  Synthetic Oligonucleotide
cauugaaccauuucugaaa

SEQ ID NO: 5022 - RNA, 19 nt, Artificial Sequence
  Synthetic Oligonucleotide
uugaaccauuucugaaaaa

SEQ ID NO: 5023 - RNA, 19 nt, Artificial Sequence
  Synthetic Oligonucleotide
gaaccauuucugaaaaauu

SEQ ID NO: 5024 - RNA, 19 nt, Artificial Sequence
  Synthetic Oligonucleotide
accauuucugaaaaauucc

SEQ ID NO: 5025 - RNA, 19 nt, Artificial Sequence
  Synthetic Oligonucleotide
aagaggccuucgggugauu

SEQ ID NO: 5026 - RNA, 19 nt, Artificial Sequence
  Synthetic Oligonucleotide
gaggccuucgggugauuga

SEQ ID NO: 5027 - RNA, 19 nt, Artificial Sequence
  Synthetic Oligonucleotide
ggccuucgggugauugaga

SEQ ID NO: 5028 - RNA, 19 nt, Artificial Sequence
  Synthetic Oligonucleotide
ccuucgggugauugagaug

SEQ ID NO: 5029 - RNA, 19 nt, Artificial Sequence
  Synthetic Oligonucleotide
uucgggugauugagaugga

SEQ ID NO: 5030 - RNA, 19 nt, Artificial Sequence
  Synthetic Oligonucleotide
cgggugauugagauggaga

SEQ ID NO: 5031 - RNA, 19 nt, Artificial Sequence
  Synthetic Oligonucleotide
gccaucugucuacuuggaa

SEQ ID NO: 5032 - RNA, 19 nt, Artificial Sequence
  Synthetic Oligonucleotide
caucugucuacuuggaaag

SEQ ID NO: 5033 - RNA, 19 nt, Artificial Sequence
  Synthetic Oligonucleotide
ucugucuacuuggaaaggc

SEQ ID NO: 5034 - RNA, 19 nt, Artificial Sequence
  Synthetic Oligonucleotide
ugucuacuuggaaaggcua

SEQ ID NO: 5035 - RNA, 19 nt, Artificial Sequence
  Synthetic Oligonucleotide
uugaccucuuugcucucca

SEQ ID NO: 5036 - RNA, 19 nt, Artificial Sequence
  Synthetic Oligonucleotide
gaccucuuugcucuccaaa

SEQ ID NO: 5037 - RNA, 19 nt, Artificial Sequence
  Synthetic Oligonucleotide
ccucuuugcucuccaaacc

SEQ ID NO: 5038 - RNA, 19 nt, Artificial Sequence
  Synthetic Oligonucleotide
ucuuugcucuccaaaccag

SEQ ID NO: 5039 - RNA, 19 nt, Artificial Sequence
  Synthetic Oligonucleotide
gugaccuccuccuccucca

SEQ ID NO: 5040 - RNA, 19 nt, Artificial Sequence
  Synthetic Oligonucleotide
aagacuggagagaauaaag

SEQ ID NO: 5041 - RNA, 19 nt, Artificial Sequence
  Synthetic Oligonucleotide
gacuggagagaauaaagag

SEQ ID NO: 5042 - RNA, 19 nt, Artificial Sequence
  Synthetic Oligonucleotide
cuggagagaauaaagagca

SEQ ID NO: 5043 - RNA, 19 nt, Artificial Sequence
  Synthetic Oligonucleotide
ggagagaauaaagagcagu

SEQ ID NO: 5044 - RNA, 19 nt, Artificial Sequence
  Synthetic Oligonucleotide
agagaauaaagagcagucg

SEQ ID NO: 5045 - RNA, 19 nt, Artificial Sequence
  Synthetic Oligonucleotide
agaauaaagagcagucgca

SEQ ID NO: 5046 - RNA, 19 nt, Artificial Sequence
  Synthetic Oligonucleotide
aauaaagagcagucgcaaa

SEQ ID NO: 5047 - RNA, 19 nt, Artificial Sequence
  Synthetic Oligonucleotide
uaaagagcagucgcaaaug

SEQ ID NO: 5048 - RNA, 19 nt, Artificial Sequence
  Synthetic Oligonucleotide
aagagcagucgcaaaugaa

SEQ ID NO: 5049 - RNA, 19 nt, Artificial Sequence
  Synthetic Oligonucleotide
caaacugguuguauguauc

SEQ ID NO: 5050 - RNA, 19 nt, Artificial Sequence
  Synthetic Oligonucleotide
gcucauuuguaaaauuguc

SEQ ID NO: 5051 - RNA, 19 nt, Artificial Sequence
  Synthetic Oligonucleotide
ucauuuguaaaauuguccu

SEQ ID NO: 5052 - RNA, 19 nt, Artificial Sequence
  Synthetic Oligonucleotide
auuuguaaaauuguccuaa

SEQ ID NO: 5053 - RNA, 19 nt, Artificial Sequence
  Synthetic Oligonucleotide
cacuguauucuguaugaau

SEQ ID NO: 5054 - RNA, 19 nt, Artificial Sequence
  Synthetic Oligonucleotide
cuguauucuguaugaaugc

SEQ ID NO: 5055 - RNA, 19 nt, Artificial Sequence
  Synthetic Oligonucleotide
guauucuguaugaaugcau

SEQ ID NO: 5056 - RNA, 19 nt, Artificial Sequence
  Synthetic Oligonucleotide
auucuguaugaaugcaugg

SEQ ID NO: 5057 - RNA, 19 nt, Artificial Sequence
  Synthetic Oligonucleotide
ucuguaugaaugcauggca

SEQ ID NO: 5058 - RNA, 19 nt, Artificial Sequence
  Synthetic Oligonucleotide
uguaugaaugcauggcaug

SEQ ID NO: 5059 - RNA, 19 nt, Artificial Sequence
  Synthetic Oligonucleotide
cuuuuauaaauaaaguuug

SEQ ID NO: 5060 - RNA, 19 nt, Artificial Sequence
  Synthetic Oligonucleotide
uuuauaaauaaaguuugca

SEQ ID NO: 5061 - RNA, 19 nt, Artificial Sequence
  Synthetic Oligonucleotide
uauaaauaaaguuugcauu

SEQ ID NO: 5062 - RNA, 19 nt, Artificial Sequence
  Synthetic Oligonucleotide
uaaauaaaguuugcauuaa

SEQ ID NO: 5063 - RNA, 19 nt, Artificial Sequence
  Synthetic Oligonucleotide
aauaaaguuugcauuaacu

SEQ ID NO: 5064 - RNA, 19 nt, Artificial Sequence
  Synthetic Oligonucleotide
uaaaguuugcauuaacuau

SEQ ID NO: 5065 - RNA, 19 nt, Artificial Sequence
  Synthetic Oligonucleotide
ccagcugaggaaauacucu

SEQ ID NO: 5066 - RNA, 19 nt, Artificial Sequence
  Synthetic Oligonucleotide
guugaaacugccaguugau

SEQ ID NO: 5067 - RNA, 19 nt, Artificial Sequence
  Synthetic Oligonucleotide
ugccaguugaucagaaaug

SEQ ID NO: 5068 - RNA, 19 nt, Artificial Sequence
  Synthetic Oligonucleotide
ggaaagcaagguuaagugg

SEQ ID NO: 5069 - RNA, 19 nt, Artificial Sequence
  Synthetic Oligonucleotide
ccagagugguccaaauuuu

SEQ ID NO: 5070 - RNA, 19 nt, Artificial Sequence
  Synthetic Oligonucleotide
agugguucaauugaaagga

SEQ ID NO: 5071 - RNA, 19 nt, Artificial Sequence
  Synthetic Oligonucleotide
ggauuagaagcugcacuug

SEQ ID NO: 5072 - RNA, 19 nt, Artificial Sequence
  Synthetic Oligonucleotide
gcugcacuuguuuauguug

SEQ ID NO: 5073 - RNA, 19 nt, Artificial Sequence
  Synthetic Oligonucleotide
gcaggaaaaaccacaggag

SEQ ID NO: 5074 - RNA, 19 nt, Artificial Sequence
  Synthetic Oligonucleotide
ucagguguuguaaguaagg

SEQ ID NO: 5075 - RNA, 19 nt, Artificial Sequence
  Synthetic Oligonucleotide
uguuguaaguaagguguuc

SEQ ID NO: 5076 - RNA, 19 nt, Artificial Sequence
  Synthetic Oligonucleotide
uucaaucaaccuaaagcua

SEQ ID NO: 5077 - RNA, 19 nt, Artificial Sequence
  Synthetic Oligonucleotide
uccugaaaggcuuggacaa

SEQ ID NO: 5078 - RNA, 19 nt, Artificial Sequence
  Synthetic Oligonucleotide
uaagccaauuaucaaagug

SEQ ID NO: 5079 - RNA, 19 nt, Artificial Sequence
  Synthetic Oligonucleotide
caaaguguugccaaaacuc

SEQ ID NO: 5080 - RNA, 19 nt, Artificial Sequence
  Synthetic Oligonucleotide
ccaaaacucuuugagucuc

SEQ ID NO: 5081 - RNA, 19 nt, Artificial Sequence
  Synthetic Oligonucleotide
gcuguucgagaugaagcca

SEQ ID NO: 5082 - RNA, 19 nt, Artificial Sequence
  Synthetic Oligonucleotide
ccauuacaaaauauaaacu

SEQ ID NO: 5083 - RNA, 19 nt, Artificial Sequence
  Synthetic Oligonucleotide
caaaauauaaacucuguuc

SEQ ID NO: 5084 - RNA, 19 nt, Artificial Sequence
  Synthetic Oligonucleotide
uauaaacucuguucaguug

SEQ ID NO: 5085 - RNA, 19 nt, Artificial Sequence
  Synthetic Oligonucleotide
ucuguucaguugaaagaac

SEQ ID NO: 5086 - RNA, 19 nt, Artificial Sequence
  Synthetic Oligonucleotide
ugaugaggugccacaaaua

SEQ ID NO: 5087 - RNA, 19 nt, Artificial Sequence
  Synthetic Oligonucleotide
caaauagaugcuuaugagc

SEQ ID NO: 5088 - RNA, 19 nt, Artificial Sequence
  Synthetic Oligonucleotide
uaugagcuuuuagaagcug

SEQ ID NO: 5089 - RNA, 19 nt, Artificial Sequence
  Synthetic Oligonucleotide
gcccuggagucuguagaag

SEQ ID NO: 5090 - RNA, 19 nt, Artificial Sequence
  Synthetic Oligonucleotide
ggagucuguagaaguacua

SEQ ID NO: 5091 - RNA, 19 nt, Artificial Sequence
  Synthetic Oligonucleotide
gcagauuuaguaaaagcau

SEQ ID NO: 5092 - RNA, 19 nt, Artificial Sequence
  Synthetic Oligonucleotide
uaaaagcauuaaagaaggu

SEQ ID NO: 5093 - RNA, 19 nt, Artificial Sequence
  Synthetic Oligonucleotide
gcauuaaagaagguuguug

SEQ ID NO: 5094 - RNA, 19 nt, Artificial Sequence
  Synthetic Oligonucleotide
agaagguuguuggaaagga

SEQ ID NO: 5095 - RNA, 19 nt, Artificial Sequence
  Synthetic Oligonucleotide
aggaagaaauuuggacaau

SEQ ID NO: 5096 - RNA, 19 nt, Artificial Sequence
  Synthetic Oligonucleotide
agugaggauguuuuagcag

SEQ ID NO: 5097 - RNA, 19 nt, Artificial Sequence
  Synthetic Oligonucleotide
uguuuuagcaguaauggau

SEQ ID NO: 5098 - RNA, 19 nt, Artificial Sequence
  Synthetic Oligonucleotide
ucaagcagcagacaucucu

SEQ ID NO: 5099 - RNA, 19 nt, Artificial Sequence
  Synthetic Oligonucleotide
agacaucucuuuuuauugc

SEQ ID NO: 5100 - RNA, 19 nt, Artificial Sequence
  Synthetic Oligonucleotide
gucagagaugccgcauuug

SEQ ID NO: 5101 - RNA, 19 nt, Artificial Sequence
  Synthetic Oligonucleotide
gcauuggguacugcuuuga

SEQ ID NO: 5102 - RNA, 19 nt, Artificial Sequence
  Synthetic Oligonucleotide
uguggacaaacucaagcuu

SEQ ID NO: 5103 - RNA, 19 nt, Artificial Sequence
  Synthetic Oligonucleotide
aaagaauguucagaaaagg

SEQ ID NO: 5104 - RNA, 19 nt, Artificial Sequence
  Synthetic Oligonucleotide
uucagaaaagguagaacug

SEQ ID NO: 5105 - RNA, 19 nt, Artificial Sequence
  Synthetic Oligonucleotide
agguagaacugauacaugg

SEQ ID NO: 5106 - RNA, 19 nt, Artificial Sequence
  Synthetic Oligonucleotide
gcagggaauacuggaacca

SEQ ID NO: 5107 - RNA, 19 nt, Artificial Sequence
  Synthetic Oligonucleotide
gccugagcucucgauagaa

SEQ ID NO: 5108 - RNA, 19 nt, Artificial Sequence
  Synthetic Oligonucleotide
ucgauagaaguaugugaag

SEQ ID NO: 5109 - RNA, 19 nt, Artificial Sequence
  Synthetic Oligonucleotide
ucuugacagcaguaacugg

SEQ ID NO: 5110 - RNA, 19 nt, Artificial Sequence
  Synthetic Oligonucleotide
agcuaauggaccgaacuga

SEQ ID NO: 5111 - RNA, 19 nt, Artificial Sequence
  Synthetic Oligonucleotide
auuagugaggaugcuagcc

SEQ ID NO: 5112 - RNA, 19 nt, Artificial Sequence
  Synthetic Oligonucleotide
agccaagaaaccuggaugg

SEQ ID NO: 5113 - RNA, 19 nt, Artificial Sequence
  Synthetic Oligonucleotide
agaaaccuggauggaaaga

SEQ ID NO: 5114 - RNA, 19 nt, Artificial Sequence
  Synthetic Oligonucleotide
ggugaugcaaaugaagcuu

SEQ ID NO: 5115 - RNA, 19 nt, Artificial Sequence
  Synthetic Oligonucleotide
aaaacgucagcucagguug

SEQ ID NO: 5116 - RNA, 19 nt, Artificial Sequence
  Synthetic Oligonucleotide
gcaaaagaagcuaugacag

SEQ ID NO: 5117 - RNA, 19 nt, Artificial Sequence
  Synthetic Oligonucleotide
acagcaauagccgaagccu

SEQ ID NO: 5118 - RNA, 19 nt, Artificial Sequence
  Synthetic Oligonucleotide
cgaagccuguauguuacca

SEQ ID NO: 5119 - RNA, 19 nt, Artificial Sequence
  Synthetic Oligonucleotide
aaaaaucagucagaaacuc

SEQ ID NO: 5120 - RNA, 19 nt, Artificial Sequence
  Synthetic Oligonucleotide
aagcuuucauuagcaaugu

SEQ ID NO: 5121 - RNA, 19 nt, Artificial Sequence
  Synthetic Oligonucleotide
ugagaagaugcagggacaa

SEQ ID NO: 5122 - RNA, 19 nt, Artificial Sequence
  Synthetic Oligonucleotide
agcaaugaugucguugauc

SEQ ID NO: 5123 - RNA, 19 nt, Artificial Sequence
  Synthetic Oligonucleotide
ugaaguggcagguauuauu

SEQ ID NO: 5124 - RNA, 19 nt, Artificial Sequence
  Synthetic Oligonucleotide
ugccuugaagggucgacuc

SEQ ID NO: 5125 - RNA, 19 nt, Artificial Sequence
  Synthetic Oligonucleotide
ugaagggucgacucaauga

SEQ ID NO: 5126 - RNA, 19 nt, Artificial Sequence
  Synthetic Oligonucleotide
cgacucaaugauucaaaua

SEQ ID NO: 5127 - RNA, 19 nt, Artificial Sequence
  Synthetic Oligonucleotide
aaugauucaaauaaaaucu

SEQ ID NO: 5128 - RNA, 19 nt, Artificial Sequence
  Synthetic Oligonucleotide
uagccaugggcccaaauau

SEQ ID NO: 5129 - RNA, 19 nt, Artificial Sequence
  Synthetic Oligonucleotide
caaauauuaagcaacaugu

SEQ ID NO: 5130 - RNA, 19 nt, Artificial Sequence
  Synthetic Oligonucleotide
uccuuggagacagcaagaa

SEQ ID NO: 5131 - RNA, 19 nt, Artificial Sequence
  Synthetic Oligonucleotide
ggagacagcaagaacaaug

SEQ ID NO: 5132 - RNA, 19 nt, Artificial Sequence
  Synthetic Oligonucleotide
ucaugaugcauuuaggaua

SEQ ID NO: 5133 - RNA, 19 nt, Artificial Sequence
  Synthetic Oligonucleotide
gcuagagaaagccaaaguu

SEQ ID NO: 5134 - RNA, 19 nt, Artificial Sequence
  Synthetic Oligonucleotide
agggaagaagaugccaagc

SEQ ID NO: 5135 - RNA, 19 nt, Artificial Sequence
  Synthetic Oligonucleotide
ggaaaagagcaaaggauga

SEQ ID NO: 5136 - RNA, 19 nt, Artificial Sequence
  Synthetic Oligonucleotide
agagcaaaggaugaaagau

SEQ ID NO: 5137 - RNA, 19 nt, Artificial Sequence
  Synthetic Oligonucleotide
cgggaugaauacauugagc

SEQ ID NO: 5138 - RNA, 19 nt, Artificial Sequence
  Synthetic Oligonucleotide
ugaauacauugagcaacua

SEQ ID NO: 5139 - RNA, 19 nt, Artificial Sequence
  Synthetic Oligonucleotide
aaguggcuuacccugaggu

SEQ ID NO: 5140 - RNA, 19 nt, Artificial Sequence
  Synthetic Oligonucleotide
cccugagguuuuuugacac

SEQ ID NO: 5141 - RNA, 19 nt, Artificial Sequence
  Synthetic Oligonucleotide
ccaauacaagcguccugau

SEQ ID NO: 5142 - RNA, 19 nt, Artificial Sequence
  Synthetic Oligonucleotide
cguccugaugaaagcacua

SEQ ID NO: 5143 - RNA, 19 nt, Artificial Sequence
  Synthetic Oligonucleotide
gaugaaagcacuagaauau

SEQ ID NO: 5144 - RNA, 19 nt, Artificial Sequence
  Synthetic Oligonucleotide
ggaaaucuuucugaaaagg

SEQ ID NO: 5145 - RNA, 19 nt, Artificial Sequence
  Synthetic Oligonucleotide
ugaaaaggauaugagcaug

SEQ ID NO: 5146 - RNA, 19 nt, Artificial Sequence
  Synthetic Oligonucleotide
agcuccaaugccaacaugu

SEQ ID NO: 5147 - RNA, 19 nt, Artificial Sequence
  Synthetic Oligonucleotide
caaugccaacauguuacgc

SEQ ID NO: 5148 - RNA, 19 nt, Artificial Sequence
  Synthetic Oligonucleotide
ugugaaaugccagaacuug

SEQ ID NO: 5149 - RNA, 19 nt, Artificial Sequence
  Synthetic Oligonucleotide
ccagaacuuguucagcaca

SEQ ID NO: 5150 - RNA, 19 nt, Artificial Sequence
  Synthetic Oligonucleotide
cacaaacuggaugacauuu

SEQ ID NO: 5151 - RNA, 19 nt, Artificial Sequence
  Synthetic Oligonucleotide
ggaugacauuuuugagcca

SEQ ID NO: 5152 - RNA, 19 nt, Artificial Sequence
  Synthetic Oligonucleotide
acauuuuugagccaguccu

SEQ ID NO: 5153 - RNA, 19 nt, Artificial Sequence
  Synthetic Oligonucleotide
ugagccaguccuuauuccu

SEQ ID NO: 5154 - RNA, 19 nt, Artificial Sequence
  Synthetic Oligonucleotide
acuggaguacuaaaagacc

SEQ ID NO: 5155 - RNA, 19 nt, Artificial Sequence
  Synthetic Oligonucleotide
ggugaagguucuggagaag

SEQ ID NO: 5156 - RNA, 19 nt, Artificial Sequence
  Synthetic Oligonucleotide
uccugagugcccuacuugu

SEQ ID NO: 5157 - RNA, 19 nt, Artificial Sequence
  Synthetic Oligonucleotide
acagccaguucucccaaau

SEQ ID NO: 5158 - RNA, 19 nt, Artificial Sequence
  Synthetic Oligonucleotide
agcuuguuaugaagugucu

SEQ ID NO: 5159 - RNA, 19 nt, Artificial Sequence
  Synthetic Oligonucleotide
ucgacuguugccugauacc

SEQ ID NO: 5160 - RNA, 19 nt, Artificial Sequence
  Synthetic Oligonucleotide
uguugccugauaccaucaa

SEQ ID NO: 5161 - RNA, 19 nt, Artificial Sequence
  Synthetic Oligonucleotide
ccugauaccaucaauagca

SEQ ID NO: 5162 - RNA, 19 nt, Artificial Sequence
  Synthetic Oligonucleotide
caucaauagcauuaaccua

SEQ ID NO: 5163 - RNA, 19 nt, Artificial Sequence
  Synthetic Oligonucleotide
auagcauuaaccuagacag

SEQ ID NO: 5164 - RNA, 19 nt, Artificial Sequence
  Synthetic Oligonucleotide
agaauucuucuggauaucc

SEQ ID NO: 5165 - RNA, 19 nt, Artificial Sequence
  Synthetic Oligonucleotide
ucuggauauccacauuuuc

SEQ ID NO: 5166 - RNA, 19 nt, Artificial Sequence
  Synthetic Oligonucleotide
caaagagaaacugaagcaa

SEQ ID NO: 5167 - RNA, 19 nt, Artificial Sequence
  Synthetic Oligonucleotide
agaaacugaagcaaugcaa

SEQ ID NO: 5168 - RNA, 19 nt, Artificial Sequence
  Synthetic Oligonucleotide
ccggaugaugaagcacagu

SEQ ID NO: 5169 - RNA, 19 nt, Artificial Sequence
  Synthetic Oligonucleotide
acagaaaagggagcaucuc

SEQ ID NO: 5170 - RNA, 19 nt, Artificial Sequence
  Synthetic Oligonucleotide
aagggagcaucucgaauag

SEQ ID NO: 5171 - RNA, 19 nt, Artificial Sequence
  Synthetic Oligonucleotide
agcaucucgaauagaugaa

SEQ ID NO: 5172 - RNA, 19 nt, Artificial Sequence
  Synthetic Oligonucleotide
agagggacuagcagaguua

SEQ ID NO: 5173 - RNA, 19 nt, Artificial Sequence
  Synthetic Oligonucleotide
uacucagaugcugacauug

SEQ ID NO: 5174 - RNA, 19 nt, Artificial Sequence
  Synthetic Oligonucleotide
gcauucagaccuggauucu

SEQ ID NO: 5175 - RNA, 19 nt, Artificial Sequence
  Synthetic Oligonucleotide
agaccuggauucuaaccag

SEQ ID NO: 5176 - RNA, 19 nt, Artificial Sequence
  Synthetic Oligonucleotide
uggauucuaaccagacuca

SEQ ID NO: 5177 - RNA, 19 nt, Artificial Sequence
  Synthetic Oligonucleotide
agcuaacauagacgacuug

SEQ ID NO: 5178 - RNA, 19 nt, Artificial Sequence
  Synthetic Oligonucleotide
acauagacgacuugaaaaa

SEQ ID NO: 5179 - RNA, 19 nt, Artificial Sequence
  Synthetic Oligonucleotide
acuagaaguccucauaguu

SEQ ID NO: 5180 - RNA, 19 nt, Artificial Sequence
  Synthetic Oligonucleotide
ggaugaguuuaguguacag

SEQ ID NO: 5181 - RNA, 19 nt, Artificial Sequence
  Synthetic Oligonucleotide
ccagauccuuuucuuuucu

SEQ ID NO: 5182 - RNA, 19 nt, Artificial Sequence
  Synthetic Oligonucleotide
uugcucauuuguaaaauug

SEQ ID NO: 5183 - RNA, 19 nt, Artificial Sequence
  Synthetic Oligonucleotide
ugaagggucacuguauucu

SEQ ID NO: 5184 - RNA, 19 nt, Artificial Sequence
  Synthetic Oligonucleotide
ggucacuguauucuguaug

SEQ ID NO: 5185 - RNA, 19 nt, Artificial Sequence
  Synthetic Oligonucleotide
uggaagcacaaugggagau

SEQ ID NO: 5186 - RNA, 19 nt, Artificial Sequence
  Synthetic Oligonucleotide
gaagcacaaugggagauga

SEQ ID NO: 5187 - RNA, 19 nt, Artificial Sequence
  Synthetic Oligonucleotide
agcacaaugggagaugaca

SEQ ID NO: 5188 - RNA, 19 nt, Artificial Sequence
  Synthetic Oligonucleotide
cacaaugggagaugacagu

SEQ ID NO: 5189 - RNA, 19 nt, Artificial Sequence
  Synthetic Oligonucleotide
caaugggagaugacaguga

SEQ ID NO: 5190 - RNA, 19 nt, Artificial Sequence
  Synthetic Oligonucleotide
augggagaugacagugagu

SEQ ID NO: 5191 - RNA, 19 nt, Artificial Sequence
  Synthetic Oligonucleotide
gggagaugacagugagugg

SEQ ID NO: 5192 - RNA, 19 nt, Artificial Sequence
  Synthetic Oligonucleotide
gagaugacagugagugguu

SEQ ID NO: 5193 - RNA, 19 nt, Artificial Sequence
  Synthetic Oligonucleotide
gaugacagugagugguuga

SEQ ID NO: 5194 - RNA, 19 nt, Artificial Sequence
  Synthetic Oligonucleotide
cugaagaucuuccagaaaa

SEQ ID NO: 5195 - RNA, 19 nt, Artificial Sequence
  Synthetic Oligonucleotide
gaagaucuuccagaaaaua

SEQ ID NO: 5196 - RNA, 19 nt, Artificial Sequence
  Synthetic Oligonucleotide
agaucuuccagaaaauaaa

SEQ ID NO: 5197 - RNA, 19 nt, Artificial Sequence
  Synthetic Oligonucleotide
aucuuccagaaaauaaagg

SEQ ID NO: 5198 - RNA, 19 nt, Artificial Sequence
  Synthetic Oligonucleotide
cuuccagaaaauaaaggau

SEQ ID NO: 5199 - RNA, 19 nt, Artificial Sequence
  Synthetic Oligonucleotide
uccagaaaauaaaggauga

SEQ ID NO: 5200 - RNA, 19 nt, Artificial Sequence
  Synthetic Oligonucleotide
cagaaaauaaaggaugaaa

SEQ ID NO: 5201 - RNA, 19 nt, Artificial Sequence
  Synthetic Oligonucleotide
gaaaauaaaggaugaaaag

SEQ ID NO: 5202 - RNA, 19 nt, Artificial Sequence
  Synthetic Oligonucleotide
gaucaaaaaauuugucacu

SEQ ID NO: 5203 - RNA, 19 nt, Artificial Sequence
  Synthetic Oligonucleotide
ucaaaaaauuugucacuga

SEQ ID NO: 5204 - RNA, 19 nt, Artificial Sequence
  Synthetic Oligonucleotide
aaaaaauuugucacugauu

SEQ ID NO: 5205 - RNA, 19 nt, Artificial Sequence
  Synthetic Oligonucleotide
aaaauuugucacugauucc

SEQ ID NO: 5206 - RNA, 19 nt, Artificial Sequence
  Synthetic Oligonucleotide
aauuugucacugauuccaa

SEQ ID NO: 5207 - RNA, 19 nt, Artificial Sequence
  Synthetic Oligonucleotide
uuugucacugauuccaaug

SEQ ID NO: 5208 - RNA, 19 nt, Artificial Sequence
  Synthetic Oligonucleotide
ugucacugauuccaaugca

SEQ ID NO: 5209 - RNA, 19 nt, Artificial Sequence
  Synthetic Oligonucleotide
ucacugauuccaaugcagu

SEQ ID NO: 5210 - RNA, 19 nt, Artificial Sequence
  Synthetic Oligonucleotide
acugauuccaaugcagugg

SEQ ID NO: 5211 - RNA, 19 nt, Artificial Sequence
  Synthetic Oligonucleotide
ugauuccaaugcagugguu

SEQ ID NO: 5212 - RNA, 19 nt, Artificial Sequence
  Synthetic Oligonucleotide
auuccaaugcagugguuca

SEQ ID NO: 5213 - RNA, 19 nt, Artificial Sequence
  Synthetic Oligonucleotide
uccaaugcagugguucaau

SEQ ID NO: 5214 - RNA, 19 nt, Artificial Sequence
  Synthetic Oligonucleotide
caaugcagugguucaauug

SEQ ID NO: 5215 - RNA, 19 nt, Artificial Sequence
  Synthetic Oligonucleotide
augcagugguucaauugaa

SEQ ID NO: 5216 - RNA, 19 nt, Artificial Sequence
  Synthetic Oligonucleotide
gcagugguucaauugaaag

SEQ ID NO: 5217 - RNA, 19 nt, Artificial Sequence
  Synthetic Oligonucleotide
ccaagaucauaguggccug

SEQ ID NO: 5218 - RNA, 19 nt, Artificial Sequence
  Synthetic Oligonucleotide
aagaucauaguggccugua

SEQ ID NO: 5219 - RNA, 19 nt, Artificial Sequence
  Synthetic Oligonucleotide
gaucauaguggccuguaua

SEQ ID NO: 5220 - RNA, 19 nt, Artificial Sequence
  Synthetic Oligonucleotide
gacacugaggaaagccuua

SEQ ID NO: 5221 - RNA, 19 nt, Artificial Sequence
  Synthetic Oligonucleotide
cacugaggaaagccuuaag

SEQ ID NO: 5222 - RNA, 19 nt, Artificial Sequence
  Synthetic Oligonucleotide
cugaggaaagccuuaagug

SEQ ID NO: 5223 - RNA, 19 nt, Artificial Sequence
  Synthetic Oligonucleotide
gaggaaagccuuaagugaa

SEQ ID NO: 5224 - RNA, 19 nt, Artificial Sequence
  Synthetic Oligonucleotide
ggaaagccuuaagugaauu

SEQ ID NO: 5225 - RNA, 19 nt, Artificial Sequence
  Synthetic Oligonucleotide
aaagccuuaagugaauuug

SEQ ID NO: 5226 - RNA, 19 nt, Artificial Sequence
  Synthetic Oligonucleotide
agccuuaagugaauuuggu

SEQ ID NO: 5227 - RNA, 19 nt, Artificial Sequence
  Synthetic Oligonucleotide
ccuuaagugaauuugguuc

SEQ ID NO: 5228 - RNA, 19 nt, Artificial Sequence
  Synthetic Oligonucleotide
uuaagugaauuugguucca

SEQ ID NO: 5229 - RNA, 19 nt, Artificial Sequence
  Synthetic Oligonucleotide
aagugaauuugguuccaaa

SEQ ID NO: 5230 - RNA, 19 nt, Artificial Sequence
  Synthetic Oligonucleotide
gugaauuugguuccaaaau

SEQ ID NO: 5231 - RNA, 19 nt, Artificial Sequence
  Synthetic Oligonucleotide
gaauuugguuccaaaauca

SEQ ID NO: 5232 - RNA, 19 nt, Artificial Sequence
  Synthetic Oligonucleotide
uucguucccaacaagaacu

SEQ ID NO: 5233 - RNA, 19 nt, Artificial Sequence
  Synthetic Oligonucleotide
cguucccaacaagaacuag

SEQ ID NO: 5234 - RNA, 19 nt, Artificial Sequence
  Synthetic Oligonucleotide
uucccaacaagaacuagaa

SEQ ID NO: 5235 - RNA, 19 nt, Artificial Sequence
  Synthetic Oligonucleotide
cccaacaagaacuagaagc

SEQ ID NO: 5236 - RNA, 19 nt, Artificial Sequence
  Synthetic Oligonucleotide
caacaagaacuagaagcua

SEQ ID NO: 5237 - RNA, 19 nt, Artificial Sequence
  Synthetic Oligonucleotide
acaacagucugcuggugga

SEQ ID NO: 5238 - RNA, 19 nt, Artificial Sequence
  Synthetic Oligonucleotide
aacagucugcugguggaga

SEQ ID NO: 5239 - RNA, 19 nt, Artificial Sequence
  Synthetic Oligonucleotide
agguggugaugauggugau

SEQ ID NO: 5240 - RNA, 19 nt, Artificial Sequence
  Synthetic Oligonucleotide
guggugaugauggugauga

SEQ ID NO: 5241 - RNA, 19 nt, Artificial Sequence
  Synthetic Oligonucleotide
aaauccuuuccaaacuucc

SEQ ID NO: 5242 - RNA, 19 nt, Artificial Sequence
  Synthetic Oligonucleotide
auccuuuccaaacuuccca

SEQ ID NO: 5243 - RNA, 19 nt, Artificial Sequence
  Synthetic Oligonucleotide
ccuuuccaaacuucccaaa

SEQ ID NO: 5244 - RNA, 19 nt, Artificial Sequence
  Synthetic Oligonucleotide
uuuccaaacuucccaaaga

SEQ ID NO: 5245 - RNA, 19 nt, Artificial Sequence
  Synthetic Oligonucleotide
uccaaacuucccaaagacu

SEQ ID NO: 5246 - RNA, 19 nt, Artificial Sequence
  Synthetic Oligonucleotide
caaacuucccaaagacuuu

SEQ ID NO: 5247 - RNA, 19 nt, Artificial Sequence
  Synthetic Oligonucleotide
aacuucccaaagacuuuua

SEQ ID NO: 5248 - RNA, 19 nt, Artificial Sequence
  Synthetic Oligonucleotide
cuucccaaagacuuuuaug

SEQ ID NO: 5249 - RNA, 19 nt, Artificial Sequence
  Synthetic Oligonucleotide
ucccaaagacuuuuaugac

SEQ ID NO: 5250 - RNA, 19 nt, Artificial Sequence
  Synthetic Oligonucleotide
ccaaagacuuuuaugacaa

SEQ ID NO: 5251 - RNA, 19 nt, Artificial Sequence
  Synthetic Oligonucleotide
aaagacuuuuaugacaaaa

SEQ ID NO: 5252 - RNA, 19 nt, Artificial Sequence
  Synthetic Oligonucleotide
agacuuuuaugacaaaauu

SEQ ID NO: 5253 - RNA, 19 nt, Artificial Sequence
  Synthetic Oligonucleotide
acuuuuaugacaaaauuga

SEQ ID NO: 5254 - RNA, 19 nt, Artificial Sequence
  Synthetic Oligonucleotide
uuuuaugacaaaauugagg

SEQ ID NO: 5255 - RNA, 19 nt, Artificial Sequence
  Synthetic Oligonucleotide
uuaugacaaaauugaggca

SEQ ID NO: 5256 - RNA, 19 nt, Artificial Sequence
  Synthetic Oligonucleotide
aaaauggcaagagagaaaa

SEQ ID NO: 5257 - RNA, 19 nt, Artificial Sequence
  Synthetic Oligonucleotide
gaagguuguuggaaaggac

SEQ ID NO: 5258 - RNA, 19 nt, Artificial Sequence
  Synthetic Oligonucleotide
agguuguuggaaaggacac

SEQ ID NO: 5259 - RNA, 19 nt, Artificial Sequence
  Synthetic Oligonucleotide
guuguuggaaaggacacca

SEQ ID NO: 5260 - RNA, 19 nt, Artificial Sequence
  Synthetic Oligonucleotide
uguuggaaaggacaccaau

SEQ ID NO: 5261 - RNA, 19 nt, Artificial Sequence
  Synthetic Oligonucleotide
uuggaaaggacaccaaugu

SEQ ID NO: 5262 - RNA, 19 nt, Artificial Sequence
  Synthetic Oligonucleotide
ggaaaggacaccaauguca

SEQ ID NO: 5263 - RNA, 19 nt, Artificial Sequence
  Synthetic Oligonucleotide
aaaggacaccaaugucaug

SEQ ID NO: 5264 - RNA, 19 nt, Artificial Sequence
  Synthetic Oligonucleotide
aggacaccaaugucauguu

SEQ ID NO: 5265 - RNA, 19 nt, Artificial Sequence
  Synthetic Oligonucleotide
uggcuuuggcagcaaaaug

SEQ ID NO: 5266 - RNA, 19 nt, Artificial Sequence
  Synthetic Oligonucleotide
gcuuuggcagcaaaauguc

SEQ ID NO: 5267 - RNA, 19 nt, Artificial Sequence
  Synthetic Oligonucleotide
uuuggcagcaaaaugucuu

SEQ ID NO: 5268 - RNA, 19 nt, Artificial Sequence
  Synthetic Oligonucleotide
uggcagcaaaaugucuuac

SEQ ID NO: 5269 - RNA, 19 nt, Artificial Sequence
  Synthetic Oligonucleotide
gcagcaaaaugucuuacug

SEQ ID NO: 5270 - RNA, 19 nt, Artificial Sequence
  Synthetic Oligonucleotide
gaagaaauuuggacaauau

SEQ ID NO: 5271 - RNA, 19 nt, Artificial Sequence
  Synthetic Oligonucleotide
agaaauuuggacaauaugc

SEQ ID NO: 5272 - RNA, 19 nt, Artificial Sequence
  Synthetic Oligonucleotide
aaauuuggacaauaugcag

SEQ ID NO: 5273 - RNA, 19 nt, Artificial Sequence
  Synthetic Oligonucleotide
auuuggacaauaugcagga

SEQ ID NO: 5274 - RNA, 19 nt, Artificial Sequence
  Synthetic Oligonucleotide
uuggacaauaugcaggaca

SEQ ID NO: 5275 - RNA, 19 nt, Artificial Sequence
  Synthetic Oligonucleotide
ggacaauaugcaggacaug

SEQ ID NO: 5276 - RNA, 19 nt, Artificial Sequence
  Synthetic Oligonucleotide
acaauaugcaggacauguu

SEQ ID NO: 5277 - RNA, 19 nt, Artificial Sequence
  Synthetic Oligonucleotide
aauaugcaggacauguugu

SEQ ID NO: 5278 - RNA, 19 nt, Artificial Sequence
  Synthetic Oligonucleotide
uaugcaggacauguugugc

SEQ ID NO: 5279 - RNA, 19 nt, Artificial Sequence
  Synthetic Oligonucleotide
ugcaggacauguugugcca

SEQ ID NO: 5280 - RNA, 19 nt, Artificial Sequence
  Synthetic Oligonucleotide
accucaagugguacaagcc

SEQ ID NO: 5281 - RNA, 19 nt, Artificial Sequence
  Synthetic Oligonucleotide
cucaagugguacaagcccu

SEQ ID NO: 5282 - RNA, 19 nt, Artificial Sequence
  Synthetic Oligonucleotide
caagugguacaagcccugc

SEQ ID NO: 5283 - RNA, 19 nt, Artificial Sequence
  Synthetic Oligonucleotide
agugguacaagcccugcag

SEQ ID NO: 5284 - RNA, 19 nt, Artificial Sequence
  Synthetic Oligonucleotide
ugguacaagcccugcagga

SEQ ID NO: 5285 - RNA, 19 nt, Artificial Sequence
  Synthetic Oligonucleotide
guacaagcccugcaggagg

SEQ ID NO: 5286 - RNA, 19 nt, Artificial Sequence
  Synthetic Oligonucleotide
acaagcccugcaggaggca

SEQ ID NO: 5287 - RNA, 19 nt, Artificial Sequence
  Synthetic Oligonucleotide
aagcccugcaggaggcaau

SEQ ID NO: 5288 - RNA, 19 nt, Artificial Sequence
  Synthetic Oligonucleotide
gcccugcaggaggcaauug

SEQ ID NO: 5289 - RNA, 19 nt, Artificial Sequence
  Synthetic Oligonucleotide
ccugcaggaggcaauugau

SEQ ID NO: 5290 - RNA, 19 nt, Artificial Sequence
  Synthetic Oligonucleotide
ugcaggaggcaauugaugc

SEQ ID NO: 5291 - RNA, 19 nt, Artificial Sequence
  Synthetic Oligonucleotide
caggaggcaauugaugcaa

SEQ ID NO: 5292 - RNA, 19 nt, Artificial Sequence
  Synthetic Oligonucleotide
ggaggcaauugaugcaauc

SEQ ID NO: 5293 - RNA, 19 nt, Artificial Sequence
  Synthetic Oligonucleotide
aggcaauugaugcaaucuu

SEQ ID NO: 5294 - RNA, 19 nt, Artificial Sequence
  Synthetic Oligonucleotide
uuacuaccacacuacagaa

SEQ ID NO: 5295 - RNA, 19 nt, Artificial Sequence
  Synthetic Oligonucleotide
acuaccacacuacagaaca

SEQ ID NO: 5296 - RNA, 19 nt, Artificial Sequence
  Synthetic Oligonucleotide
uaccacacuacagaacauc

SEQ ID NO: 5297 - RNA, 19 nt, Artificial Sequence
  Synthetic Oligonucleotide
ccacacuacagaacaucag

SEQ ID NO: 5298 - RNA, 19 nt, Artificial Sequence
  Synthetic Oligonucleotide
acacuacagaacaucagug

SEQ ID NO: 5299 - RNA, 19 nt, Artificial Sequence
  Synthetic Oligonucleotide
acuacagaacaucagugag

SEQ ID NO: 5300 - RNA, 19 nt, Artificial Sequence
  Synthetic Oligonucleotide
uacagaacaucagugagga

SEQ ID NO: 5301 - RNA, 19 nt, Artificial Sequence
  Synthetic Oligonucleotide
uuuuagcaguaauggauaa

SEQ ID NO: 5302 - RNA, 19 nt, Artificial Sequence
  Synthetic Oligonucleotide
uuagcaguaauggauaaua

SEQ ID NO: 5303 - RNA, 19 nt, Artificial Sequence
  Synthetic Oligonucleotide
agcaguaauggauaauaaa

SEQ ID NO: 5304 - RNA, 19 nt, Artificial Sequence
  Synthetic Oligonucleotide
caguaauggauaauaaaaa

SEQ ID NO: 5305 - RNA, 19 nt, Artificial Sequence
  Synthetic Oligonucleotide
caaccaucaagcagcagac

SEQ ID NO: 5306 - RNA, 19 nt, Artificial Sequence
  Synthetic Oligonucleotide
cacuacuuaagcacaucaa

SEQ ID NO: 5307 - RNA, 19 nt, Artificial Sequence
  Synthetic Oligonucleotide
cuacuuaagcacaucaaug

SEQ ID NO: 5308 - RNA, 19 nt, Artificial Sequence
  Synthetic Oligonucleotide
acuuaagcacaucaaugau

SEQ ID NO: 5309 - RNA, 19 nt, Artificial Sequence
  Synthetic Oligonucleotide
uuaagcacaucaaugauuc

SEQ ID NO: 5310 - RNA, 19 nt, Artificial Sequence
  Synthetic Oligonucleotide
aagcacaucaaugauucug

SEQ ID NO: 5311 - RNA, 19 nt, Artificial Sequence
  Synthetic Oligonucleotide
gcacaucaaugauucugcu

SEQ ID NO: 5312 - RNA, 19 nt, Artificial Sequence
  Synthetic Oligonucleotide
acaucaaugauucugcucc

SEQ ID NO: 5313 - RNA, 19 nt, Artificial Sequence
  Synthetic Oligonucleotide
aucaaugauucugcuccug

SEQ ID NO: 5314 - RNA, 19 nt, Artificial Sequence
  Synthetic Oligonucleotide
caaugauucugcuccugaa

SEQ ID NO: 5315 - RNA, 19 nt, Artificial Sequence
  Synthetic Oligonucleotide
augauucugcuccugaagu

SEQ ID NO: 5316 - RNA, 19 nt, Artificial Sequence
  Synthetic Oligonucleotide
gauucugcuccugaaguca

SEQ ID NO: 5317 - RNA, 19 nt, Artificial Sequence
  Synthetic Oligonucleotide
uucugcuccugaagucaga

SEQ ID NO: 5318 - RNA, 19 nt, Artificial Sequence
  Synthetic Oligonucleotide
cugcuccugaagucagaga

SEQ ID NO: 5319 - RNA, 19 nt, Artificial Sequence
  Synthetic Oligonucleotide
aagaucaaagaauguucag

SEQ ID NO: 5320 - RNA, 19 nt, Artificial Sequence
  Synthetic Oligonucleotide
gaucaaagaauguucagaa

SEQ ID NO: 5321 - RNA, 19 nt, Artificial Sequence
  Synthetic Oligonucleotide
gaaaccuggauggaaagaa

SEQ ID NO: 5322 - RNA, 19 nt, Artificial Sequence
  Synthetic Oligonucleotide
aaccuggauggaaagaaac

SEQ ID NO: 5323 - RNA, 19 nt, Artificial Sequence
  Synthetic Oligonucleotide
ccuggauggaaagaaacua

SEQ ID NO: 5324 - RNA, 19 nt, Artificial Sequence
  Synthetic Oligonucleotide
uggauggaaagaaacuaau

SEQ ID NO: 5325 - RNA, 19 nt, Artificial Sequence
  Synthetic Oligonucleotide
gauggaaagaaacuaauuu

SEQ ID NO: 5326 - RNA, 19 nt, Artificial Sequence
  Synthetic Oligonucleotide
uggaaagaaacuaauuuuc

SEQ ID NO: 5327 - RNA, 19 nt, Artificial Sequence
  Synthetic Oligonucleotide
gaaagaaacuaauuuucag

SEQ ID NO: 5328 - RNA, 19 nt, Artificial Sequence
  Synthetic Oligonucleotide
aagaaacuaauuuucaggu

SEQ ID NO: 5329 - RNA, 19 nt, Artificial Sequence
  Synthetic Oligonucleotide
gaaacuaauuuucagguga

SEQ ID NO: 5330 - RNA, 19 nt, Artificial Sequence
  Synthetic Oligonucleotide
aacuaauuuucaggugaug

SEQ ID NO: 5331 - RNA, 19 nt, Artificial Sequence
  Synthetic Oligonucleotide
aguugcuuugauugcccag

SEQ ID NO: 5332 - RNA, 19 nt, Artificial Sequence
  Synthetic Oligonucleotide
uugcuuugauugcccagaa

SEQ ID NO: 5333 - RNA, 19 nt, Artificial Sequence
  Synthetic Oligonucleotide
gcuuugauugcccagaagg

SEQ ID NO: 5334 - RNA, 19 nt, Artificial Sequence
  Synthetic Oligonucleotide
uuugauugcccagaaggga

SEQ ID NO: 5335 - RNA, 19 nt, Artificial Sequence
  Synthetic Oligonucleotide
ugauugcccagaagggaaa

SEQ ID NO: 5336 - RNA, 19 nt, Artificial Sequence
  Synthetic Oligonucleotide
auugcccagaagggaaauu

SEQ ID NO: 5337 - RNA, 19 nt, Artificial Sequence
  Synthetic Oligonucleotide
ugcccagaagggaaauuuu

SEQ ID NO: 5338 - RNA, 19 nt, Artificial Sequence
  Synthetic Oligonucleotide
uggacaagauuggagaugu

SEQ ID NO: 5339 - RNA, 19 nt, Artificial Sequence
  Synthetic Oligonucleotide
gacaagauuggagauguga

SEQ ID NO: 5340 - RNA, 19 nt, Artificial Sequence
  Synthetic Oligonucleotide
caagauuggagaugugaaa

SEQ ID NO: 5341 - RNA, 19 nt, Artificial Sequence
  Synthetic Oligonucleotide
agauuggagaugugaaaug

SEQ ID NO: 5342 - RNA, 19 nt, Artificial Sequence
  Synthetic Oligonucleotide
auuggagaugugaaaugug

SEQ ID NO: 5343 - RNA, 19 nt, Artificial Sequence
  Synthetic Oligonucleotide
uggagaugugaaauguggg

SEQ ID NO: 5344 - RNA, 19 nt, Artificial Sequence
  Synthetic Oligonucleotide
gagaugugaaaugugggaa

SEQ ID NO: 5345 - RNA, 19 nt, Artificial Sequence
  Synthetic Oligonucleotide
gaugugaaaugugggaaca

SEQ ID NO: 5346 - RNA, 19 nt, Artificial Sequence
  Synthetic Oligonucleotide
ugugaaaugugggaacaau

SEQ ID NO: 5347 - RNA, 19 nt, Artificial Sequence
  Synthetic Oligonucleotide
ugaaaugugggaacaaugc

SEQ ID NO: 5348 - RNA, 19 nt, Artificial Sequence
  Synthetic Oligonucleotide
aaaugugggaacaaugcaa

SEQ ID NO: 5349 - RNA, 19 nt, Artificial Sequence
  Synthetic Oligonucleotide
augugggaacaaugcaaaa

SEQ ID NO: 5350 - RNA, 19 nt, Artificial Sequence
  Synthetic Oligonucleotide
gugggaacaaugcaaaaga

SEQ ID NO: 5351 - RNA, 19 nt, Artificial Sequence
  Synthetic Oligonucleotide
ggguugaaugucaaagcuu

SEQ ID NO: 5352 - RNA, 19 nt, Artificial Sequence
  Synthetic Oligonucleotide
guugaaugucaaagcuuuc

SEQ ID NO: 5353 - RNA, 19 nt, Artificial Sequence
  Synthetic Oligonucleotide
ugaaugucaaagcuuucau

SEQ ID NO: 5354 - RNA, 19 nt, Artificial Sequence
  Synthetic Oligonucleotide
aaugucaaagcuuucauua

SEQ ID NO: 5355 - RNA, 19 nt, Artificial Sequence
  Synthetic Oligonucleotide
ugucaaagcuuucauuagc

SEQ ID NO: 5356 - RNA, 19 nt, Artificial Sequence
  Synthetic Oligonucleotide
aacccugcuuggcgugaug

SEQ ID NO: 5357 - RNA, 19 nt, Artificial Sequence
  Synthetic Oligonucleotide
cccugcuuggcgugaugua

SEQ ID NO: 5358 - RNA, 19 nt, Artificial Sequence
  Synthetic Oligonucleotide
guucuuugaggaugagaag

SEQ ID NO: 5359 - RNA, 19 nt, Artificial Sequence
  Synthetic Oligonucleotide
ucuuugaggaugagaagcc

SEQ ID NO: 5360 - RNA, 19 nt, Artificial Sequence
  Synthetic Oligonucleotide
uuugaggaugagaagccug

SEQ ID NO: 5361 - RNA, 19 nt, Artificial Sequence
  Synthetic Oligonucleotide
ugaggaugagaagccugcc

SEQ ID NO: 5362 - RNA, 19 nt, Artificial Sequence
  Synthetic Oligonucleotide
aggaugagaagccugcccu

SEQ ID NO: 5363 - RNA, 19 nt, Artificial Sequence
  Synthetic Oligonucleotide
gaugagaagccugcccucc

SEQ ID NO: 5364 - RNA, 19 nt, Artificial Sequence
  Synthetic Oligonucleotide
ugagaagccugcccuccua

SEQ ID NO: 5365 - RNA, 19 nt, Artificial Sequence
  Synthetic Oligonucleotide
agaagccugcccuccuauc

SEQ ID NO: 5366 - RNA, 19 nt, Artificial Sequence
  Synthetic Oligonucleotide
aagccugcccuccuauccc

SEQ ID NO: 5367 - RNA, 19 nt, Artificial Sequence
  Synthetic Oligonucleotide
gccugcccuccuaucccag

SEQ ID NO: 5368 - RNA, 19 nt, Artificial Sequence
  Synthetic Oligonucleotide
cugcccuccuaucccagau

SEQ ID NO: 5369 - RNA, 19 nt, Artificial Sequence
  Synthetic Oligonucleotide
gcccuccuaucccagauag

SEQ ID NO: 5370 - RNA, 19 nt, Artificial Sequence
  Synthetic Oligonucleotide
ccuccuaucccagauagau

SEQ ID NO: 5371 - RNA, 19 nt, Artificial Sequence
  Synthetic Oligonucleotide
uccuaucccagauagaugc

SEQ ID NO: 5372 - RNA, 19 nt, Artificial Sequence
  Synthetic Oligonucleotide
cuaucccagauagaugcag

SEQ ID NO: 5373 - RNA, 19 nt, Artificial Sequence
  Synthetic Oligonucleotide
aucccagauagaugcagaa

SEQ ID NO: 5374 - RNA, 19 nt, Artificial Sequence
  Synthetic Oligonucleotide
agaagaugcagggacaaag

SEQ ID NO: 5375 - RNA, 19 nt, Artificial Sequence
  Synthetic Oligonucleotide
gguacagaugaaggagaag

SEQ ID NO: 5376 - RNA, 19 nt, Artificial Sequence
  Synthetic Oligonucleotide
uacagaugaaggagaagau

SEQ ID NO: 5377 - RNA, 19 nt, Artificial Sequence
  Synthetic Oligonucleotide
cagaugaaggagaagaugg

SEQ ID NO: 5378 - RNA, 19 nt, Artificial Sequence
  Synthetic Oligonucleotide
ucguugaucuuuugccgag

SEQ ID NO: 5379 - RNA, 19 nt, Artificial Sequence
  Synthetic Oligonucleotide
uaggaaagaaggccuagau

SEQ ID NO: 5380 - RNA, 19 nt, Artificial Sequence
  Synthetic Oligonucleotide
ggaaagaaggccuagauga

SEQ ID NO: 5381 - RNA, 19 nt, Artificial Sequence
  Synthetic Oligonucleotide
aaagaaggccuagaugaag

SEQ ID NO: 5382 - RNA, 19 nt, Artificial Sequence
  Synthetic Oligonucleotide
agaaggccuagaugaagug

SEQ ID NO: 5383 - RNA, 19 nt, Artificial Sequence
  Synthetic Oligonucleotide
aaggccuagaugaaguggc

SEQ ID NO: 5384 - RNA, 19 nt, Artificial Sequence
  Synthetic Oligonucleotide
ggccuagaugaaguggcag

SEQ ID NO: 5385 - RNA, 19 nt, Artificial Sequence
  Synthetic Oligonucleotide
ccuagaugaaguggcaggu

SEQ ID NO: 5386 - RNA, 19 nt, Artificial Sequence
  Synthetic Oligonucleotide
uagaugaaguggcagguau

SEQ ID NO: 5387 - RNA, 19 nt, Artificial Sequence
  Synthetic Oligonucleotide
cgaauauaggugaacuucc

SEQ ID NO: 5388 - RNA, 19 nt, Artificial Sequence
  Synthetic Oligonucleotide
aauauaggugaacuuccaa

SEQ ID NO: 5389 - RNA, 19 nt, Artificial Sequence
  Synthetic Oligonucleotide
uauaggugaacuuccaacu

SEQ ID NO: 5390 - RNA, 19 nt, Artificial Sequence
  Synthetic Oligonucleotide
uaggugaacuuccaacugc

SEQ ID NO: 5391 - RNA, 19 nt, Artificial Sequence
  Synthetic Oligonucleotide
ggugaacuuccaacugccu

SEQ ID NO: 5392 - RNA, 19 nt, Artificial Sequence
  Synthetic Oligonucleotide
ugaacuuccaacugccuug

SEQ ID NO: 5393 - RNA, 19 nt, Artificial Sequence
  Synthetic Oligonucleotide
aacuuccaacugccuugaa

SEQ ID NO: 5394 - RNA, 19 nt, Artificial Sequence
  Synthetic Oligonucleotide
cuuccaacugccuugaagg

SEQ ID NO: 5395 - RNA, 19 nt, Artificial Sequence
  Synthetic Oligonucleotide
uccaacugccuugaagggu

SEQ ID NO: 5396 - RNA, 19 nt, Artificial Sequence
  Synthetic Oligonucleotide
caacugccuugaagggucg

SEQ ID NO: 5397 - RNA, 19 nt, Artificial Sequence
  Synthetic Oligonucleotide
aacaacuggcaguagccau

SEQ ID NO: 5398 - RNA, 19 nt, Artificial Sequence
  Synthetic Oligonucleotide
acagcaagaacaauguucg

SEQ ID NO: 5399 - RNA, 19 nt, Artificial Sequence
  Synthetic Oligonucleotide
agcaagaacaauguucgag

SEQ ID NO: 5400 - RNA, 19 nt, Artificial Sequence
  Synthetic Oligonucleotide
caagaacaauguucgagcu

SEQ ID NO: 5401 - RNA, 19 nt, Artificial Sequence
  Synthetic Oligonucleotide
agaacaauguucgagcugc

SEQ ID NO: 5402 - RNA, 19 nt, Artificial Sequence
  Synthetic Oligonucleotide
aacaauguucgagcugcug

SEQ ID NO: 5403 - RNA, 19 nt, Artificial Sequence
  Synthetic Oligonucleotide
caauguucgagcugcugcc

SEQ ID NO: 5404 - RNA, 19 nt, Artificial Sequence
  Synthetic Oligonucleotide
auguucgagcugcugcccu

SEQ ID NO: 5405 - RNA, 19 nt, Artificial Sequence
  Synthetic Oligonucleotide
cgacugugaaugcuugggc

SEQ ID NO: 5406 - RNA, 19 nt, Artificial Sequence
  Synthetic Oligonucleotide
acugugaaugcuugggcag

SEQ ID NO: 5407 - RNA, 19 nt, Artificial Sequence
  Synthetic Oligonucleotide
ugugaaugcuugggcagaa

SEQ ID NO: 5408 - RNA, 19 nt, Artificial Sequence
  Synthetic Oligonucleotide
aggagaagaucuuucugaa

SEQ ID NO: 5409 - RNA, 19 nt, Artificial Sequence
  Synthetic Oligonucleotide
gccuagaagaucgaaaugg

SEQ ID NO: 5410 - RNA, 19 nt, Artificial Sequence
  Synthetic Oligonucleotide
cuagaagaucgaaauggag

SEQ ID NO: 5411 - RNA, 19 nt, Artificial Sequence
  Synthetic Oligonucleotide
agaagaucgaaauggagau

SEQ ID NO: 5412 - RNA, 19 nt, Artificial Sequence
  Synthetic Oligonucleotide
caugaugcauuuaggauau

SEQ ID NO: 5413 - RNA, 19 nt, Artificial Sequence
  Synthetic Oligonucleotide
ugaugcauuuaggauauga

SEQ ID NO: 5414 - RNA, 19 nt, Artificial Sequence
  Synthetic Oligonucleotide
augcauuuaggauaugaaa

SEQ ID NO: 5415 - RNA, 19 nt, Artificial Sequence
  Synthetic Oligonucleotide
gcauuuaggauaugaaaaa

SEQ ID NO: 5416 - RNA, 19 nt, Artificial Sequence
  Synthetic Oligonucleotide
auuuaggauaugaaaaaau

SEQ ID NO: 5417 - RNA, 19 nt, Artificial Sequence
  Synthetic Oligonucleotide
ccaaggcuacugggaaacu

SEQ ID NO: 5418 - RNA, 19 nt, Artificial Sequence
  Synthetic Oligonucleotide
aaggcuacugggaaacuaa

SEQ ID NO: 5419 - RNA, 19 nt, Artificial Sequence
  Synthetic Oligonucleotide
ggcuacugggaaacuaaag

SEQ ID NO: 5420 - RNA, 19 nt, Artificial Sequence
  Synthetic Oligonucleotide
cuacugggaaacuaaagcc

SEQ ID NO: 5421 - RNA, 19 nt, Artificial Sequence
  Synthetic Oligonucleotide
acugggaaacuaaagccaa

SEQ ID NO: 5422 - RNA, 19 nt, Artificial Sequence
  Synthetic Oligonucleotide
ugggaaacuaaagccaacu

SEQ ID NO: 5423 - RNA, 19 nt, Artificial Sequence
  Synthetic Oligonucleotide
ggaaacuaaagccaacuuc

SEQ ID NO: 5424 - RNA, 19 nt, Artificial Sequence
  Synthetic Oligonucleotide
aaacuaaagccaacuucua

SEQ ID NO: 5425 - RNA, 19 nt, Artificial Sequence
  Synthetic Oligonucleotide
acuaaagccaacuucuaaa

SEQ ID NO: 5426 - RNA, 19 nt, Artificial Sequence
  Synthetic Oligonucleotide
uaaagccaacuucuaaaga

SEQ ID NO: 5427 - RNA, 19 nt, Artificial Sequence
  Synthetic Oligonucleotide
ggccuauuuuuauuguugu

SEQ ID NO: 5428 - RNA, 19 nt, Artificial Sequence
  Synthetic Oligonucleotide
ccuauuuuuauuguuguuc

SEQ ID NO: 5429 - RNA, 19 nt, Artificial Sequence
  Synthetic Oligonucleotide
uauuuuuauuguuguucca

SEQ ID NO: 5430 - RNA, 19 nt, Artificial Sequence
  Synthetic Oligonucleotide
uuuuuauuguuguuccaaa

SEQ ID NO: 5431 - RNA, 19 nt, Artificial Sequence
  Synthetic Oligonucleotide
uuuauuguuguuccaaaug

SEQ ID NO: 5432 - RNA, 19 nt, Artificial Sequence
  Synthetic Oligonucleotide
uauuguuguuccaaaugga

SEQ ID NO: 5433 - RNA, 19 nt, Artificial Sequence
  Synthetic Oligonucleotide
gaaggugcuaaaguggaau

SEQ ID NO: 5434 - RNA, 19 nt, Artificial Sequence
  Synthetic Oligonucleotide
aggugcuaaaguggaauuu

SEQ ID NO: 5435 - RNA, 19 nt, Artificial Sequence
  Synthetic Oligonucleotide
auaucaucuuacugagaau

SEQ ID NO: 5436 - RNA, 19 nt, Artificial Sequence
  Synthetic Oligonucleotide
aucaucuuacugagaauga

SEQ ID NO: 5437 - RNA, 19 nt, Artificial Sequence
  Synthetic Oligonucleotide
caucuuacugagaaugaag

SEQ ID NO: 5438 - RNA, 19 nt, Artificial Sequence
  Synthetic Oligonucleotide
ucuuacugagaaugaagca

SEQ ID NO: 5439 - RNA, 19 nt, Artificial Sequence
  Synthetic Oligonucleotide
gucaagguuggagaaccaa

SEQ ID NO: 5440 - RNA, 19 nt, Artificial Sequence
  Synthetic Oligonucleotide
caagguuggagaaccaaag

SEQ ID NO: 5441 - RNA, 19 nt, Artificial Sequence
  Synthetic Oligonucleotide
agguuggagaaccaaagga

SEQ ID NO: 5442 - RNA, 19 nt, Artificial Sequence
  Synthetic Oligonucleotide
guuggagaaccaaaggaug

SEQ ID NO: 5443 - RNA, 19 nt, Artificial Sequence
  Synthetic Oligonucleotide
uggagaaccaaaggauguc

SEQ ID NO: 5444 - RNA, 19 nt, Artificial Sequence
  Synthetic Oligonucleotide
gagaaccaaaggaugucau

SEQ ID NO: 5445 - RNA, 19 nt, Artificial Sequence
  Synthetic Oligonucleotide
gaaccaaaggaugucauuc

SEQ ID NO: 5446 - RNA, 19 nt, Artificial Sequence
  Synthetic Oligonucleotide
accaaaggaugucauucgu

SEQ ID NO: 5447 - RNA, 19 nt, Artificial Sequence
  Synthetic Oligonucleotide
caaaggaugucauucguaa

SEQ ID NO: 5448 - RNA, 19 nt, Artificial Sequence
  Synthetic Oligonucleotide
aaggaugucauucguaaag

SEQ ID NO: 5449 - RNA, 19 nt, Artificial Sequence
  Synthetic Oligonucleotide
ggaugucauucguaaagau

SEQ ID NO: 5450 - RNA, 19 nt, Artificial Sequence
  Synthetic Oligonucleotide
cauccugaaccggaugugc

SEQ ID NO: 5451 - RNA, 19 nt, Artificial Sequence
  Synthetic Oligonucleotide
uccugaaccggaugugccu

SEQ ID NO: 5452 - RNA, 19 nt, Artificial Sequence
  Synthetic Oligonucleotide
cugaaccggaugugccuug

SEQ ID NO: 5453 - RNA, 19 nt, Artificial Sequence
  Synthetic Oligonucleotide
gaaccggaugugccuuguc

SEQ ID NO: 5454 - RNA, 19 nt, Artificial Sequence
  Synthetic Oligonucleotide
accggaugugccuugucua

SEQ ID NO: 5455 - RNA, 19 nt, Artificial Sequence
  Synthetic Oligonucleotide
cggaugugccuugucuacc

SEQ ID NO: 5456 - RNA, 19 nt, Artificial Sequence
  Synthetic Oligonucleotide
gaugugccuugucuaccca

SEQ ID NO: 5457 - RNA, 19 nt, Artificial Sequence
  Synthetic Oligonucleotide
auccaaaaacucuaagcag

SEQ ID NO: 5458 - RNA, 19 nt, Artificial Sequence
  Synthetic Oligonucleotide
ccaaaaacucuaagcagag

SEQ ID NO: 5459 - RNA, 19 nt, Artificial Sequence
  Synthetic Oligonucleotide
aaaaacucuaagcagagag

SEQ ID NO: 5460 - RNA, 19 nt, Artificial Sequence
  Synthetic Oligonucleotide
aaacucuaagcagagagca

SEQ ID NO: 5461 - RNA, 19 nt, Artificial Sequence
  Synthetic Oligonucleotide
acucuaagcagagagcaga

SEQ ID NO: 5462 - RNA, 19 nt, Artificial Sequence
  Synthetic Oligonucleotide
ucuaagcagagagcagagu

SEQ ID NO: 5463 - RNA, 19 nt, Artificial Sequence
  Synthetic Oligonucleotide
uaagcagagagcagagugc

SEQ ID NO: 5464 - RNA, 19 nt, Artificial Sequence
  Synthetic Oligonucleotide
agcagagagcagagugccu

SEQ ID NO: 5465 - RNA, 19 nt, Artificial Sequence
  Synthetic Oligonucleotide
cagagagcagagugccugg

SEQ ID NO: 5466 - RNA, 19 nt, Artificial Sequence
  Synthetic Oligonucleotide
gagagcagagugccuggaa

SEQ ID NO: 5467 - RNA, 19 nt, Artificial Sequence
  Synthetic Oligonucleotide
gagcagagugccuggaaga

SEQ ID NO: 5468 - RNA, 19 nt, Artificial Sequence
  Synthetic Oligonucleotide
cccaggaaaagccuuaaag

SEQ ID NO: 5469 - RNA, 19 nt, Artificial Sequence
  Synthetic Oligonucleotide
ggaucagguguucaaacug

SEQ ID NO: 5470 - RNA, 19 nt, Artificial Sequence
  Synthetic Oligonucleotide
aucagguguucaaacugau

SEQ ID NO: 5471 - RNA, 19 nt, Artificial Sequence
  Synthetic Oligonucleotide
cagguguucaaacugauug

SEQ ID NO: 5472 - RNA, 19 nt, Artificial Sequence
  Synthetic Oligonucleotide
gguguucaaacugauugga

SEQ ID NO: 5473 - RNA, 19 nt, Artificial Sequence
  Synthetic Oligonucleotide
uguucaaacugauuggaaa

SEQ ID NO: 5474 - RNA, 19 nt, Artificial Sequence
  Synthetic Oligonucleotide
uucaaacugauuggaaauc

SEQ ID NO: 5475 - RNA, 19 nt, Artificial Sequence
  Synthetic Oligonucleotide
caaacugauuggaaaucuu

SEQ ID NO: 5476 - RNA, 19 nt, Artificial Sequence
  Synthetic Oligonucleotide
aacugauuggaaaucuuuc

SEQ ID NO: 5477 - RNA, 19 nt, Artificial Sequence
  Synthetic Oligonucleotide
uuaagcggucagcaaagag

SEQ ID NO: 5478 - RNA, 19 nt, Artificial Sequence
  Synthetic Oligonucleotide
aagcggucagcaaagagac

SEQ ID NO: 5479 - RNA, 19 nt, Artificial Sequence
  Synthetic Oligonucleotide
gcggucagcaaagagaccc

SEQ ID NO: 5480 - RNA, 19 nt, Artificial Sequence
  Synthetic Oligonucleotide
ggucagcaaagagacccuc

SEQ ID NO: 5481 - RNA, 19 nt, Artificial Sequence
  Synthetic Oligonucleotide
ucagcaaagagacccucug

SEQ ID NO: 5482 - RNA, 19 nt, Artificial Sequence
  Synthetic Oligonucleotide
agcaaagagacccucugcu

SEQ ID NO: 5483 - RNA, 19 nt, Artificial Sequence
  Synthetic Oligonucleotide
caaagagacccucugcugc

SEQ ID NO: 5484 - RNA, 19 nt, Artificial Sequence
  Synthetic Oligonucleotide
guuacgcaagggaccagcu

SEQ ID NO: 5485 - RNA, 19 nt, Artificial Sequence
  Synthetic Oligonucleotide
uacgcaagggaccagcuga

SEQ ID NO: 5486 - RNA, 19 nt, Artificial Sequence
  Synthetic Oligonucleotide
uccgccgagaauuccagcu

SEQ ID NO: 5487 - RNA, 19 nt, Artificial Sequence
  Synthetic Oligonucleotide
cgccgagaauuccagcugg

SEQ ID NO: 5488 - RNA, 19 nt, Artificial Sequence
  Synthetic Oligonucleotide
caagauccgggcuguuucu

SEQ ID NO: 5489 - RNA, 19 nt, Artificial Sequence
  Synthetic Oligonucleotide
agauccgggcuguuucucc

SEQ ID NO: 5490 - RNA, 19 nt, Artificial Sequence
  Synthetic Oligonucleotide
ucgaugacaugcacaguaa

SEQ ID NO: 5491 - RNA, 19 nt, Artificial Sequence
  Synthetic Oligonucleotide
gaugacaugcacaguaaua

SEQ ID NO: 5492 - RNA, 19 nt, Artificial Sequence
  Synthetic Oligonucleotide
ugacaugcacaguaauaca

SEQ ID NO: 5493 - RNA, 19 nt, Artificial Sequence
  Synthetic Oligonucleotide
acaugcacaguaauacagc

SEQ ID NO: 5494 - RNA, 19 nt, Artificial Sequence
  Synthetic Oligonucleotide
augcacaguaauacagcau

SEQ ID NO: 5495 - RNA, 19 nt, Artificial Sequence
  Synthetic Oligonucleotide
gcacaguaauacagcaucc

SEQ ID NO: 5496 - RNA, 19 nt, Artificial Sequence
  Synthetic Oligonucleotide
acaguaauacagcauccac

SEQ ID NO: 5497 - RNA, 19 nt, Artificial Sequence
  Synthetic Oligonucleotide
aguaauacagcauccacaa

SEQ ID NO: 5498 - RNA, 19 nt, Artificial Sequence
  Synthetic Oligonucleotide
uaauacagcauccacaauc

SEQ ID NO: 5499 - RNA, 19 nt, Artificial Sequence
  Synthetic Oligonucleotide
auacagcauccacaaucaa

SEQ ID NO: 5500 - RNA, 19 nt, Artificial Sequence
  Synthetic Oligonucleotide
acagcauccacaaucaauu

SEQ ID NO: 5501 - RNA, 19 nt, Artificial Sequence
  Synthetic Oligonucleotide
agcauccacaaucaauuuc

SEQ ID NO: 5502 - RNA, 19 nt, Artificial Sequence
  Synthetic Oligonucleotide
cauccacaaucaauuucau

SEQ ID NO: 5503 - RNA, 19 nt, Artificial Sequence
  Synthetic Oligonucleotide
uccacaaucaauuucauua

SEQ ID NO: 5504 - RNA, 19 nt, Artificial Sequence
  Synthetic Oligonucleotide
cacaaucaauuucauuauc

SEQ ID NO: 5505 - RNA, 19 nt, Artificial Sequence
  Synthetic Oligonucleotide
caaucaauuucauuaucuc

SEQ ID NO: 5506 - RNA, 19 nt, Artificial Sequence
  Synthetic Oligonucleotide
aucaauuucauuaucuccc

SEQ ID NO: 5507 - RNA, 19 nt, Artificial Sequence
  Synthetic Oligonucleotide
caauuucauuaucucccaa

SEQ ID NO: 5508 - RNA, 19 nt, Artificial Sequence
  Synthetic Oligonucleotide
auuucauuaucucccaagu

SEQ ID NO: 5509 - RNA, 19 nt, Artificial Sequence
  Synthetic Oligonucleotide
uucauuaucucccaaguag

SEQ ID NO: 5510 - RNA, 19 nt, Artificial Sequence
  Synthetic Oligonucleotide
cauuaucucccaaguagcc

SEQ ID NO: 5511 - RNA, 19 nt, Artificial Sequence
  Synthetic Oligonucleotide
uuaucucccaaguagccag

SEQ ID NO: 5512 - RNA, 19 nt, Artificial Sequence
  Synthetic Oligonucleotide
aucucccaaguagccagug

SEQ ID NO: 5513 - RNA, 19 nt, Artificial Sequence
  Synthetic Oligonucleotide
cucccaaguagccaguggu

SEQ ID NO: 5514 - RNA, 19 nt, Artificial Sequence
  Synthetic Oligonucleotide
cccaaguagccagugguga

SEQ ID NO: 5515 - RNA, 19 nt, Artificial Sequence
  Synthetic Oligonucleotide
uugcccgggaggccuccac

SEQ ID NO: 5516 - RNA, 19 nt, Artificial Sequence
  Synthetic Oligonucleotide
gcccgggaggccuccacug

SEQ ID NO: 5517 - RNA, 19 nt, Artificial Sequence
  Synthetic Oligonucleotide
ccgggaggccuccacugga

SEQ ID NO: 5518 - RNA, 19 nt, Artificial Sequence
  Synthetic Oligonucleotide
gggaggccuccacuggagu

SEQ ID NO: 5519 - RNA, 19 nt, Artificial Sequence
  Synthetic Oligonucleotide
ucaucaccuuaaugcugga

SEQ ID NO: 5520 - RNA, 19 nt, Artificial Sequence
  Synthetic Oligonucleotide
aucaccuuaaugcuggauu

SEQ ID NO: 5521 - RNA, 19 nt, Artificial Sequence
  Synthetic Oligonucleotide
caccuuaaugcuggauucu

SEQ ID NO: 5522 - RNA, 19 nt, Artificial Sequence
  Synthetic Oligonucleotide
ccuuaaugcuggauucucg

SEQ ID NO: 5523 - RNA, 19 nt, Artificial Sequence
  Synthetic Oligonucleotide
uuaaugcuggauucucgga

SEQ ID NO: 5524 - RNA, 19 nt, Artificial Sequence
  Synthetic Oligonucleotide
aaugcuggauucucggauu

SEQ ID NO: 5525 - RNA, 19 nt, Artificial Sequence
  Synthetic Oligonucleotide
ugcuggauucucggauuga

SEQ ID NO: 5526 - RNA, 19 nt, Artificial Sequence
  Synthetic Oligonucleotide
cuggauucucggauugaag

SEQ ID NO: 5527 - RNA, 19 nt, Artificial Sequence
  Synthetic Oligonucleotide
ggauucucggauugaagau

SEQ ID NO: 5528 - RNA, 19 nt, Artificial Sequence
  Synthetic Oligonucleotide
cucugugaaccucuuggug

SEQ ID NO: 5529 - RNA, 19 nt, Artificial Sequence
  Synthetic Oligonucleotide
cugugaaccucuugguggu

SEQ ID NO: 5530 - RNA, 19 nt, Artificial Sequence
  Synthetic Oligonucleotide
gugaaccucuuggugguga

SEQ ID NO: 5531 - RNA, 19 nt, Artificial Sequence
  Synthetic Oligonucleotide
gaaccucuugguggugaag

SEQ ID NO: 5532 - RNA, 19 nt, Artificial Sequence
  Synthetic Oligonucleotide
aagacagccugcuagcaac

SEQ ID NO: 5533 - RNA, 19 nt, Artificial Sequence
  Synthetic Oligonucleotide
ccaguucucccaaauucuc

SEQ ID NO: 5534 - RNA, 19 nt, Artificial Sequence
  Synthetic Oligonucleotide
aguucucccaaauucucag

SEQ ID NO: 5535 - RNA, 19 nt, Artificial Sequence
  Synthetic Oligonucleotide
uucucccaaauucucagag

SEQ ID NO: 5536 - RNA, 19 nt, Artificial Sequence
  Synthetic Oligonucleotide
cucccaaauucucagagcu

SEQ ID NO: 5537 - RNA, 19 nt, Artificial Sequence
  Synthetic Oligonucleotide
cccaaauucucagagcuug

SEQ ID NO: 5538 - RNA, 19 nt, Artificial Sequence
  Synthetic Oligonucleotide
caaauucucagagcuuguu

SEQ ID NO: 5539 - RNA, 19 nt, Artificial Sequence
  Synthetic Oligonucleotide
aauucucagagcuuguuau

SEQ ID NO: 5540 - RNA, 19 nt, Artificial Sequence
  Synthetic Oligonucleotide
uucucagagcuuguuauga

SEQ ID NO: 5541 - RNA, 19 nt, Artificial Sequence
  Synthetic Oligonucleotide
cucagagcuuguuaugaag

SEQ ID NO: 5542 - RNA, 19 nt, Artificial Sequence
  Synthetic Oligonucleotide
cagagcuuguuaugaagug

SEQ ID NO: 5543 - RNA, 19 nt, Artificial Sequence
  Synthetic Oligonucleotide
auagcauuaaccuagacag

SEQ ID NO: 5544 - RNA, 19 nt, Artificial Sequence
  Synthetic Oligonucleotide
agcauuaaccuagacagaa

SEQ ID NO: 5545 - RNA, 19 nt, Artificial Sequence
  Synthetic Oligonucleotide
cauuaaccuagacagaauu

SEQ ID NO: 5546 - RNA, 19 nt, Artificial Sequence
  Synthetic Oligonucleotide
uuaaccuagacagaauucu

SEQ ID NO: 5547 - RNA, 19 nt, Artificial Sequence
  Synthetic Oligonucleotide
aaccuagacagaauucuuc

SEQ ID NO: 5548 - RNA, 19 nt, Artificial Sequence
  Synthetic Oligonucleotide
ccuagacagaauucuucug

SEQ ID NO: 5549 - RNA, 19 nt, Artificial Sequence
  Synthetic Oligonucleotide
uauccacauuuucaugaag

SEQ ID NO: 5550 - RNA, 19 nt, Artificial Sequence
  Synthetic Oligonucleotide
cugaagcaaugcaaaagug

SEQ ID NO: 5551 - RNA, 19 nt, Artificial Sequence
  Synthetic Oligonucleotide
gaagcaaugcaaaagugaa

SEQ ID NO: 5552 - RNA, 19 nt, Artificial Sequence
  Synthetic Oligonucleotide
agcaaugcaaaagugaauu

SEQ ID NO: 5553 - RNA, 19 nt, Artificial Sequence
  Synthetic Oligonucleotide
acaguauggaccagacugg

SEQ ID NO: 5554 - RNA, 19 nt, Artificial Sequence
  Synthetic Oligonucleotide
aguauggaccagacuggga

SEQ ID NO: 5555 - RNA, 19 nt, Artificial Sequence
  Synthetic Oligonucleotide
uauggaccagacugggagc

SEQ ID NO: 5556 - RNA, 19 nt, Artificial Sequence
  Synthetic Oligonucleotide
uggaccagacugggagcaa

SEQ ID NO: 5557 - RNA, 19 nt, Artificial Sequence
  Synthetic Oligonucleotide
gaccagacugggagcaagu

SEQ ID NO: 5558 - RNA, 19 nt, Artificial Sequence
  Synthetic Oligonucleotide
ccagacugggagcaagucu

SEQ ID NO: 5559 - RNA, 19 nt, Artificial Sequence
  Synthetic Oligonucleotide
agacugggagcaagucuga

SEQ ID NO: 5560 - RNA, 19 nt, Artificial Sequence
  Synthetic Oligonucleotide
acugggagcaagucugaua

SEQ ID NO: 5561 - RNA, 19 nt, Artificial Sequence
  Synthetic Oligonucleotide
ugggagcaagucugauaag

SEQ ID NO: 5562 - RNA, 19 nt, Artificial Sequence
  Synthetic Oligonucleotide
ggagcaagucugauaagga

SEQ ID NO: 5563 - RNA, 19 nt, Artificial Sequence
  Synthetic Oligonucleotide
agcaagucugauaaggaaa

SEQ ID NO: 5564 - RNA, 19 nt, Artificial Sequence
  Synthetic Oligonucleotide
caagucugauaaggaaaca

SEQ ID NO: 5565 - RNA, 19 nt, Artificial Sequence
  Synthetic Oligonucleotide
agucugauaaggaaacaga

SEQ ID NO: 5566 - RNA, 19 nt, Artificial Sequence
  Synthetic Oligonucleotide
ucugauaaggaaacagaaa

SEQ ID NO: 5567 - RNA, 19 nt, Artificial Sequence
  Synthetic Oligonucleotide
ugauaaggaaacagaaaag

SEQ ID NO: 5568 - RNA, 19 nt, Artificial Sequence
  Synthetic Oligonucleotide
auaaggaaacagaaaaggg

SEQ ID NO: 5569 - RNA, 19 nt, Artificial Sequence
  Synthetic Oligonucleotide
caucucgaauagaugaaaa

SEQ ID NO: 5570 - RNA, 19 nt, Artificial Sequence
  Synthetic Oligonucleotide
ucucgaauagaugaaaaau

SEQ ID NO: 5571 - RNA, 19 nt, Artificial Sequence
  Synthetic Oligonucleotide
ucgaauagaugaaaaauca

SEQ ID NO: 5572 - RNA, 19 nt, Artificial Sequence
  Synthetic Oligonucleotide
gaauagaugaaaaaucauc

SEQ ID NO: 5573 - RNA, 19 nt, Artificial Sequence
  Synthetic Oligonucleotide
auagaugaaaaaucaucaa

SEQ ID NO: 5574 - RNA, 19 nt, Artificial Sequence
  Synthetic Oligonucleotide
agaugaaaaaucaucaaag

SEQ ID NO: 5575 - RNA, 19 nt, Artificial Sequence
  Synthetic Oligonucleotide
augaaaaaucaucaaaggc

SEQ ID NO: 5576 - RNA, 19 nt, Artificial Sequence
  Synthetic Oligonucleotide
gaaaaaucaucaaaggcca

SEQ ID NO: 5577 - RNA, 19 nt, Artificial Sequence
  Synthetic Oligonucleotide
aaaaucaucaaaggccaaa

SEQ ID NO: 5578 - RNA, 19 nt, Artificial Sequence
  Synthetic Oligonucleotide
gaaugauuucuuagcugag

SEQ ID NO: 5579 - RNA, 19 nt, Artificial Sequence
  Synthetic Oligonucleotide
augauuucuuagcugagau

SEQ ID NO: 5580 - RNA, 19 nt, Artificial Sequence
  Synthetic Oligonucleotide
gauuucuuagcugagauuu

SEQ ID NO: 5581 - RNA, 19 nt, Artificial Sequence
  Synthetic Oligonucleotide
uuucuuagcugagauuuuu

SEQ ID NO: 5582 - RNA, 19 nt, Artificial Sequence
  Synthetic Oligonucleotide
ucuuagcugagauuuuuaa

SEQ ID NO: 5583 - RNA, 19 nt, Artificial Sequence
  Synthetic Oligonucleotide
uuagcugagauuuuuaaga

SEQ ID NO: 5584 - RNA, 19 nt, Artificial Sequence
  Synthetic Oligonucleotide
agcugagauuuuuaagaag

SEQ ID NO: 5585 - RNA, 19 nt, Artificial Sequence
  Synthetic Oligonucleotide
cugagauuuuuaagaagau

SEQ ID NO: 5586 - RNA, 19 nt, Artificial Sequence
  Synthetic Oligonucleotide
gagauuuuuaagaagauug

SEQ ID NO: 5587 - RNA, 19 nt, Artificial Sequence
  Synthetic Oligonucleotide
gauuuuuaagaagauuggc

SEQ ID NO: 5588 - RNA, 19 nt, Artificial Sequence
  Synthetic Oligonucleotide
acuagcagaguuauaugaa

SEQ ID NO: 5589 - RNA, 19 nt, Artificial Sequence
  Synthetic Oligonucleotide
uagcagaguuauaugaaua

SEQ ID NO: 5590 - RNA, 19 nt, Artificial Sequence
  Synthetic Oligonucleotide
gcagaguuauaugaauaua

SEQ ID NO: 5591 - RNA, 19 nt, Artificial Sequence
  Synthetic Oligonucleotide
agaguuauaugaauauaag

SEQ ID NO: 5592 - RNA, 19 nt, Artificial Sequence
  Synthetic Oligonucleotide
aguuauaugaauauaagaa

SEQ ID NO: 5593 - RNA, 19 nt, Artificial Sequence
  Synthetic Oligonucleotide
uuauaugaauauaagaaga

SEQ ID NO: 5594 - RNA, 19 nt, Artificial Sequence
  Synthetic Oligonucleotide
auaugaauauaagaagaaa

SEQ ID NO: 5595 - RNA, 19 nt, Artificial Sequence
  Synthetic Oligonucleotide
gcugacauugaaccauuuc

SEQ ID NO: 5596 - RNA, 19 nt, Artificial Sequence
  Synthetic Oligonucleotide
ugacauugaaccauuucug

SEQ ID NO: 5597 - RNA, 19 nt, Artificial Sequence
  Synthetic Oligonucleotide
acauugaaccauuucugaa

SEQ ID NO: 5598 - RNA, 19 nt, Artificial Sequence
  Synthetic Oligonucleotide
auugaaccauuucugaaaa

SEQ ID NO: 5599 - RNA, 19 nt, Artificial Sequence
  Synthetic Oligonucleotide
ugaaccauuucugaaaaau

SEQ ID NO: 5600 - RNA, 19 nt, Artificial Sequence
  Synthetic Oligonucleotide
aaccauuucugaaaaauuc

SEQ ID NO: 5601 - RNA, 19 nt, Artificial Sequence
  Synthetic Oligonucleotide
aaagaggccuucgggugau

SEQ ID NO: 5602 - RNA, 19 nt, Artificial Sequence
  Synthetic Oligonucleotide
agaggccuucgggugauug

SEQ ID NO: 5603 - RNA, 19 nt, Artificial Sequence
  Synthetic Oligonucleotide
aggccuucgggugauugag

SEQ ID NO: 5604 - RNA, 19 nt, Artificial Sequence
  Synthetic Oligonucleotide
gccuucgggugauugagau

SEQ ID NO: 5605 - RNA, 19 nt, Artificial Sequence
  Synthetic Oligonucleotide
cuucgggugauugagaugg

SEQ ID NO: 5606 - RNA, 19 nt, Artificial Sequence
  Synthetic Oligonucleotide
ucgggugauugagauggag

SEQ ID NO: 5607 - RNA, 19 nt, Artificial Sequence
  Synthetic Oligonucleotide
ggccaucugucuacuugga

SEQ ID NO: 5608 - RNA, 19 nt, Artificial Sequence
  Synthetic Oligonucleotide
ccaucugucuacuuggaaa

SEQ ID NO: 5609 - RNA, 19 nt, Artificial Sequence
  Synthetic Oligonucleotide
aucugucuacuuggaaagg

SEQ ID NO: 5610 - RNA, 19 nt, Artificial Sequence
  Synthetic Oligonucleotide
cugucuacuuggaaaggcu

SEQ ID NO: 5611 - RNA, 19 nt, Artificial Sequence
  Synthetic Oligonucleotide
uuugaccucuuugcucucc

SEQ ID NO: 5612 - RNA, 19 nt, Artificial Sequence
  Synthetic Oligonucleotide
ugaccucuuugcucuccaa

SEQ ID NO: 5613 - RNA, 19 nt, Artificial Sequence
  Synthetic Oligonucleotide
accucuuugcucuccaaac

SEQ ID NO: 5614 - RNA, 19 nt, Artificial Sequence
  Synthetic Oligonucleotide
cucuuugcucuccaaacca

SEQ ID NO: 5615 - RNA, 19 nt, Artificial Sequence
  Synthetic Oligonucleotide
ugugaccuccuccuccucc

SEQ ID NO: 5616 - RNA, 19 nt, Artificial Sequence
  Synthetic Oligonucleotide
aaagacuggagagaauaaa

SEQ ID NO: 5617 - RNA, 19 nt, Artificial Sequence
  Synthetic Oligonucleotide
agacuggagagaauaaaga

SEQ ID NO: 5618 - RNA, 19 nt, Artificial Sequence
  Synthetic Oligonucleotide
acuggagagaauaaagagc

SEQ ID NO: 5619 - RNA, 19 nt, Artificial Sequence
  Synthetic Oligonucleotide
uggagagaauaaagagcag

SEQ ID NO: 5620 - RNA, 19 nt, Artificial Sequence
  Synthetic Oligonucleotide
gagagaauaaagagcaguc

SEQ ID NO: 5621 - RNA, 19 nt, Artificial Sequence
  Synthetic Oligonucleotide
gagaauaaagagcagucgc

SEQ ID NO: 5622 - RNA, 19 nt, Artificial Sequence
  Synthetic Oligonucleotide
gaauaaagagcagucgcaa

SEQ ID NO: 5623 - RNA, 19 nt, Artificial Sequence
  Synthetic Oligonucleotide
auaaagagcagucgcaaau

SEQ ID NO: 5624 - RNA, 19 nt, Artificial Sequence
  Synthetic Oligonucleotide
aaagagcagucgcaaauga

SEQ ID NO: 5625 - RNA, 19 nt, Artificial Sequence
  Synthetic Oligonucleotide
acaaacugguuguauguau

SEQ ID NO: 5626 - RNA, 19 nt, Artificial Sequence
  Synthetic Oligonucleotide
ugcucauuuguaaaauugu

SEQ ID NO: 5627 - RNA, 19 nt, Artificial Sequence
  Synthetic Oligonucleotide
cucauuuguaaaauugucc

SEQ ID NO: 5628 - RNA, 19 nt, Artificial Sequence
  Synthetic Oligonucleotide
cauuuguaaaauuguccua

SEQ ID NO: 5629 - RNA, 19 nt, Artificial Sequence
  Synthetic Oligonucleotide
ucacuguauucuguaugaa

SEQ ID NO: 5630 - RNA, 19 nt, Artificial Sequence
  Synthetic Oligonucleotide
acuguauucuguaugaaug

SEQ ID NO: 5631 - RNA, 19 nt, Artificial Sequence
  Synthetic Oligonucleotide
uguauucuguaugaaugca

SEQ ID NO: 5632 - RNA, 19 nt, Artificial Sequence
  Synthetic Oligonucleotide
uauucuguaugaaugcaug

SEQ ID NO: 5633 - RNA, 19 nt, Artificial Sequence
  Synthetic Oligonucleotide
uucuguaugaaugcauggc

SEQ ID NO: 5634 - RNA, 19 nt, Artificial Sequence
  Synthetic Oligonucleotide
cuguaugaaugcauggcau

SEQ ID NO: 5635 - RNA, 19 nt, Artificial Sequence
  Synthetic Oligonucleotide
ucuuuuauaaauaaaguuu

SEQ ID NO: 5636 - RNA, 19 nt, Artificial Sequence
  Synthetic Oligonucleotide
uuuuauaaauaaaguuugc

SEQ ID NO: 5637 - RNA, 19 nt, Artificial Sequence
  Synthetic Oligonucleotide
uuauaaauaaaguuugcau

SEQ ID NO: 5638 - RNA, 19 nt, Artificial Sequence
  Synthetic Oligonucleotide
auaaauaaaguuugcauua

SEQ ID NO: 5639 - RNA, 19 nt, Artificial Sequence
  Synthetic Oligonucleotide
aaauaaaguuugcauuaac

SEQ ID NO: 5640 - RNA, 19 nt, Artificial Sequence
  Synthetic Oligonucleotide
auaaaguuugcauuaacua

SEQ ID NO: 5641 - RNA, 19 nt, Artificial Sequence
  Synthetic Oligonucleotide
cccagcugaggaaauacuc

SEQ ID NO: 5642 - RNA, 19 nt, Artificial Sequence
  Synthetic Oligonucleotide
gguugaaacugccaguuga

SEQ ID NO: 5643 - RNA, 19 nt, Artificial Sequence
  Synthetic Oligonucleotide
cugccaguugaucagaaau

SEQ ID NO: 5644 - RNA, 19 nt, Artificial Sequence
  Synthetic Oligonucleotide
uggaaagcaagguuaagug

SEQ ID NO: 5645 - RNA, 19 nt, Artificial Sequence
  Synthetic Oligonucleotide
cccagagugguccaaauuu

SEQ ID NO: 5646 - RNA, 19 nt, Artificial Sequence
  Synthetic Oligonucleotide
cagugguucaauugaaagg

SEQ ID NO: 5647 - RNA, 19 nt, Artificial Sequence
  Synthetic Oligonucleotide
aggauuagaagcugcacuu

SEQ ID NO: 5648 - RNA, 19 nt, Artificial Sequence
  Synthetic Oligonucleotide
agcugcacuuguuuauguu

SEQ ID NO: 5649 - RNA, 19 nt, Artificial Sequence
  Synthetic Oligonucleotide
agcaggaaaaaccacagga

SEQ ID NO: 5650 - RNA, 19 nt, Artificial Sequence
  Synthetic Oligonucleotide
gucagguguuguaaguaag

SEQ ID NO: 5651 - RNA, 19 nt, Artificial Sequence
  Synthetic Oligonucleotide
guguuguaaguaagguguu

SEQ ID NO: 5652 - RNA, 19 nt, Artificial Sequence
  Synthetic Oligonucleotide
guucaaucaaccuaaagcu

SEQ ID NO: 5653 - RNA, 19 nt, Artificial Sequence
  Synthetic Oligonucleotide
cuccugaaaggcuuggaca

SEQ ID NO: 5654 - RNA, 19 nt, Artificial Sequence
  Synthetic Oligonucleotide
uuaagccaauuaucaaagu

SEQ ID NO: 5655 - RNA, 19 nt, Artificial Sequence
  Synthetic Oligonucleotide
ucaaaguguugccaaaacu

SEQ ID NO: 5656 - RNA, 19 nt, Artificial Sequence
  Synthetic Oligonucleotide
gccaaaacucuuugagucu

SEQ ID NO: 5657 - RNA, 19 nt, Artificial Sequence
  Synthetic Oligonucleotide
ggcuguucgagaugaagcc

SEQ ID NO: 5658 - RNA, 19 nt, Artificial Sequence
  Synthetic Oligonucleotide
cccauuacaaaauauaaac

SEQ ID NO: 5659 - RNA, 19 nt, Artificial Sequence
  Synthetic Oligonucleotide
acaaaauauaaacucuguu

SEQ ID NO: 5660 - RNA, 19 nt, Artificial Sequence
  Synthetic Oligonucleotide
auauaaacucuguucaguu

SEQ ID NO: 5661 - RNA, 19 nt, Artificial Sequence
  Synthetic Oligonucleotide
cucuguucaguugaaagaa

SEQ ID NO: 5662 - RNA, 19 nt, Artificial Sequence
  Synthetic Oligonucleotide
gugaugaggugccacaaau

SEQ ID NO: 5663 - RNA, 19 nt, Artificial Sequence
  Synthetic Oligonucleotide
acaaauagaugcuuaugag

SEQ ID NO: 5664 - RNA, 19 nt, Artificial Sequence
  Synthetic Oligonucleotide
uuaugagcuuuuagaagcu

SEQ ID NO: 5665 - RNA, 19 nt, Artificial Sequence
  Synthetic Oligonucleotide
ggcccuggagucuguagaa

SEQ ID NO: 5666 - RNA, 19 nt, Artificial Sequence
  Synthetic Oligonucleotide
uggagucuguagaaguacu

SEQ ID NO: 5667 - RNA, 19 nt, Artificial Sequence
  Synthetic Oligonucleotide
ugcagauuuaguaaaagca

SEQ ID NO: 5668 - RNA, 19 nt, Artificial Sequence
  Synthetic Oligonucleotide
guaaaagcauuaaagaagg

SEQ ID NO: 5669 - RNA, 19 nt, Artificial Sequence
  Synthetic Oligonucleotide
agcauuaaagaagguuguu

SEQ ID NO: 5670 - RNA, 19 nt, Artificial Sequence
  Synthetic Oligonucleotide
aagaagguuguuggaaagg

SEQ ID NO: 5671 - RNA, 19 nt, Artificial Sequence
  Synthetic Oligonucleotide
aaggaagaaauuuggacaa

SEQ ID NO: 5672 - RNA, 19 nt, Artificial Sequence
  Synthetic Oligonucleotide
cagugaggauguuuuagca

SEQ ID NO: 5673 - RNA, 19 nt, Artificial Sequence
  Synthetic Oligonucleotide
auguuuuagcaguaaugga

SEQ ID NO: 5674 - RNA, 19 nt, Artificial Sequence
  Synthetic Oligonucleotide
aucaagcagcagacaucuc

SEQ ID NO: 5675 - RNA, 19 nt, Artificial Sequence
  Synthetic Oligonucleotide
cagacaucucuuuuuauug

SEQ ID NO: 5676 - RNA, 19 nt, Artificial Sequence
  Synthetic Oligonucleotide
agucagagaugccgcauuu

SEQ ID NO: 5677 - RNA, 19 nt, Artificial Sequence
  Synthetic Oligonucleotide
agcauuggguacugcuuug

SEQ ID NO: 5678 - RNA, 19 nt, Artificial Sequence
  Synthetic Oligonucleotide
auguggacaaacucaagcu

SEQ ID NO: 5679 - RNA, 19 nt, Artificial Sequence
  Synthetic Oligonucleotide
caaagaauguucagaaaag

SEQ ID NO: 5680 - RNA, 19 nt, Artificial Sequence
  Synthetic Oligonucleotide
guucagaaaagguagaacu

SEQ ID NO: 5681 - RNA, 19 nt, Artificial Sequence
  Synthetic Oligonucleotide
aagguagaacugauacaug

SEQ ID NO: 5682 - RNA, 19 nt, Artificial Sequence
  Synthetic Oligonucleotide
cgcagggaauacuggaacc

SEQ ID NO: 5683 - RNA, 19 nt, Artificial Sequence
  Synthetic Oligonucleotide
agccugagcucucgauaga

SEQ ID NO: 5684 - RNA, 19 nt, Artificial Sequence
  Synthetic Oligonucleotide
cucgauagaaguaugugaa

SEQ ID NO: 5685 - RNA, 19 nt, Artificial Sequence
  Synthetic Oligonucleotide
uucuugacagcaguaacug

SEQ ID NO: 5686 - RNA, 19 nt, Artificial Sequence
  Synthetic Oligonucleotide
gagcuaauggaccgaacug

SEQ ID NO: 5687 - RNA, 19 nt, Artificial Sequence
  Synthetic Oligonucleotide
cauuagugaggaugcuagc

SEQ ID NO: 5688 - RNA, 19 nt, Artificial Sequence
  Synthetic Oligonucleotide
uagccaagaaaccuggaug

SEQ ID NO: 5689 - RNA, 19 nt, Artificial Sequence
  Synthetic Oligonucleotide
aagaaaccuggauggaaag

SEQ ID NO: 5690 - RNA, 19 nt, Artificial Sequence
  Synthetic Oligonucleotide
aggugaugcaaaugaagcu

SEQ ID NO: 5691 - RNA, 19 nt, Artificial Sequence
  Synthetic Oligonucleotide
caaaacgucagcucagguu

SEQ ID NO: 5692 - RNA, 19 nt, Artificial Sequence
  Synthetic Oligonucleotide
ugcaaaagaagcuaugaca

SEQ ID NO: 5693 - RNA, 19 nt, Artificial Sequence
  Synthetic Oligonucleotide
gacagcaauagccgaagcc

SEQ ID NO: 5694 - RNA, 19 nt, Artificial Sequence
  Synthetic Oligonucleotide
ccgaagccuguauguuacc

SEQ ID NO: 5695 - RNA, 19 nt, Artificial Sequence
  Synthetic Oligonucleotide
caaaaaucagucagaaacu

SEQ ID NO: 5696 - RNA, 19 nt, Artificial Sequence
  Synthetic Oligonucleotide
aaagcuuucauuagcaaug

SEQ ID NO: 5697 - RNA, 19 nt, Artificial Sequence
  Synthetic Oligonucleotide
uugagaagaugcagggaca

SEQ ID NO: 5698 - RNA, 19 nt, Artificial Sequence
  Synthetic Oligonucleotide
gagcaaugaugucguugau

SEQ ID NO: 5699 - RNA, 19 nt, Artificial Sequence
  Synthetic Oligonucleotide
augaaguggcagguauuau

SEQ ID NO: 5700 - RNA, 19 nt, Artificial Sequence
  Synthetic Oligonucleotide
cugccuugaagggucgacu

SEQ ID NO: 5701 - RNA, 19 nt, Artificial Sequence
  Synthetic Oligonucleotide
uugaagggucgacucaaug

SEQ ID NO: 5702 - RNA, 19 nt, Artificial Sequence
  Synthetic Oligonucleotide
ucgacucaaugauucaaau

SEQ ID NO: 5703 - RNA, 19 nt, Artificial Sequence
  Synthetic Oligonucleotide
caaugauucaaauaaaauc

SEQ ID NO: 5704 - RNA, 19 nt, Artificial Sequence
  Synthetic Oligonucleotide
guagccaugggcccaaaua

SEQ ID NO: 5705 - RNA, 19 nt, Artificial Sequence
  Synthetic Oligonucleotide
ccaaauauuaagcaacaug

SEQ ID NO: 5706 - RNA, 19 nt, Artificial Sequence
  Synthetic Oligonucleotide
guccuuggagacagcaaga

SEQ ID NO: 5707 - RNA, 19 nt, Artificial Sequence
  Synthetic Oligonucleotide
uggagacagcaagaacaau

SEQ ID NO: 5708 - RNA, 19 nt, Artificial Sequence
  Synthetic Oligonucleotide
uucaugaugcauuuaggau

SEQ ID NO: 5709 - RNA, 19 nt, Artificial Sequence
  Synthetic Oligonucleotide
ugcuagagaaagccaaagu

SEQ ID NO: 5710 - RNA, 19 nt, Artificial Sequence
  Synthetic Oligonucleotide
aagggaagaagaugccaag

SEQ ID NO: 5711 - RNA, 19 nt, Artificial Sequence
  Synthetic Oligonucleotide
uggaaaagagcaaaggaug

SEQ ID NO: 5712 - RNA, 19 nt, Artificial Sequence
  Synthetic Oligonucleotide
aagagcaaaggaugaaaga

SEQ ID NO: 5713 - RNA, 19 nt, Artificial Sequence
  Synthetic Oligonucleotide
acgggaugaauacauugag

SEQ ID NO: 5714 - RNA, 19 nt, Artificial Sequence
  Synthetic Oligonucleotide
augaauacauugagcaacu

SEQ ID NO: 5715 - RNA, 19 nt, Artificial Sequence
  Synthetic Oligonucleotide
aaaguggcuuacccugagg

SEQ ID NO: 5716 - RNA, 19 nt, Artificial Sequence
  Synthetic Oligonucleotide
acccugagguuuuuugaca

SEQ ID NO: 5717 - RNA, 19 nt, Artificial Sequence
  Synthetic Oligonucleotide
accaauacaagcguccuga

SEQ ID NO: 5718 - RNA, 19 nt, Artificial Sequence
  Synthetic Oligonucleotide
gcguccugaugaaagcacu

SEQ ID NO: 5719 - RNA, 19 nt, Artificial Sequence
  Synthetic Oligonucleotide
ugaugaaagcacuagaaua

SEQ ID NO: 5720 - RNA, 19 nt, Artificial Sequence
  Synthetic Oligonucleotide
uggaaaucuuucugaaaag

SEQ ID NO: 5721 - RNA, 19 nt, Artificial Sequence
  Synthetic Oligonucleotide
cugaaaaggauaugagcau

SEQ ID NO: 5722 - RNA, 19 nt, Artificial Sequence
  Synthetic Oligonucleotide
aagcuccaaugccaacaug

SEQ ID NO: 5723 - RNA, 19 nt, Artificial Sequence
  Synthetic Oligonucleotide
ccaaugccaacauguuacg

SEQ ID NO: 5724 - RNA, 19 nt, Artificial Sequence
  Synthetic Oligonucleotide
augugaaaugccagaacuu

SEQ ID NO: 5725 - RNA, 19 nt, Artificial Sequence
  Synthetic Oligonucleotide
gccagaacuuguucagcac

SEQ ID NO: 5726 - RNA, 19 nt, Artificial Sequence
  Synthetic Oligonucleotide
gcacaaacuggaugacauu

SEQ ID NO: 5727 - RNA, 19 nt, Artificial Sequence
  Synthetic Oligonucleotide
uggaugacauuuuugagcc

SEQ ID NO: 5728 - RNA, 19 nt, Artificial Sequence
  Synthetic Oligonucleotide
gacauuuuugagccagucc

SEQ ID NO: 5729 - RNA, 19 nt, Artificial Sequence
  Synthetic Oligonucleotide
uugagccaguccuuauucc

SEQ ID NO: 5730 - RNA, 19 nt, Artificial Sequence
  Synthetic Oligonucleotide
cacuggaguacuaaaagac

SEQ ID NO: 5731 - RNA, 19 nt, Artificial Sequence
  Synthetic Oligonucleotide
uggugaagguucuggagaa

SEQ ID NO: 5732 - RNA, 19 nt, Artificial Sequence
  Synthetic Oligonucleotide
auccugagugcccuacuug

SEQ ID NO: 5733 - RNA, 19 nt, Artificial Sequence
  Synthetic Oligonucleotide
aacagccaguucucccaaa

SEQ ID NO: 5734 - RNA, 19 nt, Artificial Sequence
  Synthetic Oligonucleotide
gagcuuguuaugaaguguc

SEQ ID NO: 5735 - RNA, 19 nt, Artificial Sequence
  Synthetic Oligonucleotide
uucgacuguugccugauac

SEQ ID NO: 5736 - RNA, 19 nt, Artificial Sequence
  Synthetic Oligonucleotide
cuguugccugauaccauca

SEQ ID NO: 5737 - RNA, 19 nt, Artificial Sequence
  Synthetic Oligonucleotide
gccugauaccaucaauagc

SEQ ID NO: 5738 - RNA, 19 nt, Artificial Sequence
  Synthetic Oligonucleotide
ccaucaauagcauuaaccu

SEQ ID NO: 5739 - RNA, 19 nt, Artificial Sequence
  Synthetic Oligonucleotide
aauagcauuaaccuagaca

SEQ ID NO: 5740 - RNA, 19 nt, Artificial Sequence
  Synthetic Oligonucleotide
cagaauucuucuggauauc

SEQ ID NO: 5741 - RNA, 19 nt, Artificial Sequence
  Synthetic Oligonucleotide
uucuggauauccacauuuu

SEQ ID NO: 5742 - RNA, 19 nt, Artificial Sequence
  Synthetic Oligonucleotide
ccaaagagaaacugaagca

SEQ ID NO: 5743 - RNA, 19 nt, Artificial Sequence
  Synthetic Oligonucleotide
gagaaacugaagcaaugca

SEQ ID NO: 5744 - RNA, 19 nt, Artificial Sequence
  Synthetic Oligonucleotide
gccggaugaugaagcacag

SEQ ID NO: 5745 - RNA, 19 nt, Artificial Sequence
  Synthetic Oligonucleotide
aacagaaaagggagcaucu

SEQ ID NO: 5746 - RNA, 19 nt, Artificial Sequence
  Synthetic Oligonucleotide
aaagggagcaucucgaaua

SEQ ID NO: 5747 - RNA, 19 nt, Artificial Sequence
  Synthetic Oligonucleotide
gagcaucucgaauagauga

SEQ ID NO: 5748 - RNA, 19 nt, Artificial Sequence
  Synthetic Oligonucleotide
aagagggacuagcagaguu

SEQ ID NO: 5749 - RNA, 19 nt, Artificial Sequence
  Synthetic Oligonucleotide
auacucagaugcugacauu

SEQ ID NO: 5750 - RNA, 19 nt, Artificial Sequence
  Synthetic Oligonucleotide
agcauucagaccuggauuc

SEQ ID NO: 5751 - RNA, 19 nt, Artificial Sequence
  Synthetic Oligonucleotide
cagaccuggauucuaacca

SEQ ID NO: 5752 - RNA, 19 nt, Artificial Sequence
  Synthetic Oligonucleotide
cuggauucuaaccagacuc

SEQ ID NO: 5753 - RNA, 19 nt, Artificial Sequence
  Synthetic Oligonucleotide
cagcuaacauagacgacuu

SEQ ID NO: 5754 - RNA, 19 nt, Artificial Sequence
  Synthetic Oligonucleotide
aacauagacgacuugaaaa

SEQ ID NO: 5755 - RNA, 19 nt, Artificial Sequence
  Synthetic Oligonucleotide
aacuagaaguccucauagu

SEQ ID NO: 5756 - RNA, 19 nt, Artificial Sequence
  Synthetic Oligonucleotide
uggaugaguuuaguguaca

SEQ ID NO: 5757 - RNA, 19 nt, Artificial Sequence
  Synthetic Oligonucleotide
cccagauccuuuucuuuuc

SEQ ID NO: 5758 - RNA, 19 nt, Artificial Sequence
  Synthetic Oligonucleotide
auugcucauuuguaaaauu

SEQ ID NO: 5759 - RNA, 19 nt, Artificial Sequence
  Synthetic Oligonucleotide
cugaagggucacuguauuc

SEQ ID NO: 5760 - RNA, 19 nt, Artificial Sequence
  Synthetic Oligonucleotide
gggucacuguauucuguau

SEQ ID NO: 5761 - RNA, 21 nt, Artificial Sequence
  Synthetic Oligonucleotide
uggaaccaaauucacuuaagg

SEQ ID NO: 5762 - RNA, 21 nt, Artificial Sequence
  Synthetic Oligonucleotide
ccuuaagugaauuugguucac

SEQ ID NO: 5763 - DNA, 25 bp, Artificial Sequence
  Synthetic Oligonucleotide
uuaagugaauuugguuccuaaauca

SEQ ID NO: 5764 - DNA, 25 bp, Artificial Sequence
  Synthetic Oligonucleotide
uuaagugaauuugguuccauaauca

SEQ ID NO: 5765 - DNA, 25 bp, Artificial Sequence
  Synthetic Oligonucleotide
uuaagugaauuugguuccaauauca

SEQ ID NO: 5766 - DNA, 25 bp, Artificial Sequence
  Synthetic Oligonucleotide
uuaagugaauuugguuccaaaguca

SEQ ID NO: 5767 - DNA, 25 bp, Artificial Sequence
  Synthetic Oligonucleotide
uuaagugaauuugguuccaaaaaca

SEQ ID NO: 5768 - DNA, 25 bp, Artificial Sequence
  Synthetic Oligonucleotide
uuaagugaauuugguuccaaaauta

SEQ ID NO: 5769 - DNA, 25 bp, Artificial Sequence
  Synthetic Oligonucleotide
uuaagugaauuugguuccaaaauct

SEQ ID NO: 5770 - RNA, 27 nt, Artificial Sequence
  Synthetic Oligonucleotide
agauuuuggaaccaaauucacuuaagg

SEQ ID NO: 5771 - RNA, 27 nt, Artificial Sequence
  Synthetic Oligonucleotide
uaauuuuggaaccaaauucacuuaagg

SEQ ID NO: 5772 - RNA, 27 nt, Artificial Sequence
  Synthetic Oligonucleotide
uguuuuuggaaccaaauucacuuaagg

SEQ ID NO: 5773 - RNA, 27 nt, Artificial Sequence
  Synthetic Oligonucleotide
ugacuuuggaaccaaauucacuuaagg

SEQ ID NO: 5774 - RNA, 27 nt, Artificial Sequence
  Synthetic Oligonucleotide
ugauauuggaaccaaauucacuuaagg

SEQ ID NO: 5775 - RNA, 27 nt, Artificial Sequence
  Synthetic Oligonucleotide
ugauuauggaaccaaauucacuuaagg

SEQ ID NO: 5776 - RNA, 27 nt, Artificial Sequence
  Synthetic Oligonucleotide
ugauuuaggaaccaaauucacuuaagg

SEQ ID NO: 5777 - DNA, 25 bp, Artificial Sequence
  Synthetic Oligonucleotide
caacaagaacuagaagcuuaauugg

SEQ ID NO: 5778 - DNA, 25 bp, Artificial Sequence
  Synthetic Oligonucleotide
caacaagaacuagaagcuagauugg

SEQ ID NO: 5779 - DNA, 25 bp, Artificial Sequence
  Synthetic Oligonucleotide
caacaagaacuagaagcuaauuugg

SEQ ID NO: 5780 - DNA, 25 bp, Artificial Sequence
  Synthetic Oligonucleotide
caacaagaacuagaagcuaaagugg

SEQ ID NO: 5781 - DNA, 25 bp, Artificial Sequence
  Synthetic Oligonucleotide
caacaagaacuagaagcuaaauagg

SEQ ID NO: 5782 - DNA, 25 bp, Artificial Sequence
  Synthetic Oligonucleotide
caacaagaacuagaagcuaaauutg

SEQ ID NO: 5783 - DNA, 25 bp, Artificial Sequence
  Synthetic Oligonucleotide
caacaagaacuagaagcuaaauuga

SEQ ID NO: 5784 - RNA, 27 nt, Artificial Sequence
  Synthetic Oligonucleotide
ucaauuuagcuucuaguucuuguuggg

SEQ ID NO: 5785 - RNA, 27 nt, Artificial Sequence
  Synthetic Oligonucleotide
caaauuuagcuucuaguucuuguuggg

SEQ ID NO: 5786 - RNA, 27 nt, Artificial Sequence
  Synthetic Oligonucleotide
ccuauuuagcuucuaguucuuguuggg

SEQ ID NO: 5787 - RNA, 27 nt, Artificial Sequence
  Synthetic Oligonucleotide
ccacuuuagcuucuaguucuuguuggg

SEQ ID NO: 5788 - RNA, 27 nt, Artificial Sequence
  Synthetic Oligonucleotide
ccaaauuagcuucuaguucuuguuggg

SEQ ID NO: 5789 - RNA, 27 nt, Artificial Sequence
  Synthetic Oligonucleotide
ccaaucuagcuucuaguucuuguuggg

SEQ ID NO: 5790 - RNA, 27 nt, Artificial Sequence
  Synthetic Oligonucleotide
ccaauuaagcuucuaguucuuguuggg

SEQ ID NO: 5791 - DNA, 25 bp, Artificial Sequence
  Synthetic Oligonucleotide
caguaauggauaauaaaauuccaac

SEQ ID NO: 5792 - DNA, 25 bp, Artificial Sequence
  Synthetic Oligonucleotide
caguaauggauaauaaaaaaccaac

SEQ ID NO: 5793 - DNA, 25 bp, Artificial Sequence
  Synthetic Oligonucleotide
caguaauggauaauaaaaauacaac

SEQ ID NO: 5794 - DNA, 25 bp, Artificial Sequence
  Synthetic Oligonucleotide
caguaauggauaauaaaaaucuaac

SEQ ID NO: 5795 - DNA, 25 bp, Artificial Sequence
  Synthetic Oligonucleotide
caguaauggauaauaaaaauccuac

SEQ ID NO: 5796 - DNA, 25 bp, Artificial Sequence
  Synthetic Oligonucleotide
caguaauggauaauaaaaauccagc

SEQ ID NO: 5797 - DNA, 25 bp, Artificial Sequence
  Synthetic Oligonucleotide
caguaauggauaauaaaaauccaaa

SEQ ID NO: 5798 - RNA, 27 nt, Artificial Sequence
  Synthetic Oligonucleotide
uuuggauuuuuauuauccauuacugcu

SEQ ID NO: 5799 - RNA, 27 nt, Artificial Sequence
  Synthetic Oligonucleotide
gcuggauuuuuauuauccauuacugcu

SEQ ID NO: 5800 - RNA, 27 nt, Artificial Sequence
  Synthetic Oligonucleotide
guaggauuuuuauuauccauuacugcu

SEQ ID NO: 5801 - RNA, 27 nt, Artificial Sequence
  Synthetic Oligonucleotide
guuagauuuuuauuauccauuacugcu

SEQ ID NO: 5802 - RNA, 27 nt, Artificial Sequence
  Synthetic Oligonucleotide
guuguauuuuuauuauccauuacugcu

SEQ ID NO: 5803 - RNA, 27 nt, Artificial Sequence
  Synthetic Oligonucleotide
guugguuuuuuauuauccauuacugcu

SEQ ID NO: 5804 - RNA, 27 nt, Artificial Sequence
  Synthetic Oligonucleotide
guuggaauuuuauuauccauuacugcu

SEQ ID NO: 5805 - DNA, 25 bp, Artificial Sequence
  Synthetic Oligonucleotide
gauggaaagaaacuaauuaucaggt

SEQ ID NO: 5806 - DNA, 25 bp, Artificial Sequence
  Synthetic Oligonucleotide
gauggaaagaaacuaauuuacaggt

SEQ ID NO: 5807 - DNA, 25 bp, Artificial Sequence
  Synthetic Oligonucleotide
gauggaaagaaacuaauuuuaaggt

SEQ ID NO: 5808 - DNA, 25 bp, Artificial Sequence
  Synthetic Oligonucleotide
gauggaaagaaacuaauuuucgggt

SEQ ID NO: 5809 - DNA, 25 bp, Artificial Sequence
  Synthetic Oligonucleotide
gauggaaagaaacuaauuuucaagt

SEQ ID NO: 5810 - DNA, 25 bp, Artificial Sequence
  Synthetic Oligonucleotide
gauggaaagaaacuaauuuucagtt

SEQ ID NO: 5811 - DNA, 25 bp, Artificial Sequence
  Synthetic Oligonucleotide
gauggaaagaaacuaauuuucagga

SEQ ID NO: 5812 - RNA, 27 nt, Artificial Sequence
  Synthetic Oligonucleotide
uccugaaaauuaguuucuuuccaucca

SEQ ID NO: 5813 - RNA, 27 nt, Artificial Sequence
  Synthetic Oligonucleotide
aacugaaaauuaguuucuuuccaucca

SEQ ID NO: 5814 - RNA, 27 nt, Artificial Sequence
  Synthetic Oligonucleotide
acuugaaaauuaguuucuuuccaucca

SEQ ID NO: 5815 - RNA, 27 nt, Artificial Sequence
  Synthetic Oligonucleotide
acccgaaaauuaguuucuuuccaucca

SEQ ID NO: 5816 - RNA, 27 nt, Artificial Sequence
  Synthetic Oligonucleotide
accuuaaaauuaguuucuuuccaucca

SEQ ID NO: 5817 - RNA, 27 nt, Artificial Sequence
  Synthetic Oligonucleotide
accuguaaauuaguuucuuuccaucca

SEQ ID NO: 5818 - RNA, 27 nt, Artificial Sequence
  Synthetic Oligonucleotide
accugauaauuaguuucuuuccaucca

SEQ ID NO: 5819 - DNA, 25 bp, Artificial Sequence
  Synthetic Oligonucleotide
ggaugucauucguaaagaaguucgt

SEQ ID NO: 5820 - DNA, 25 bp, Artificial Sequence
  Synthetic Oligonucleotide
ggaugucauucguaaagauuuucgt

SEQ ID NO: 5821 - DNA, 25 bp, Artificial Sequence
  Synthetic Oligonucleotide
ggaugucauucguaaagaugaucgt

SEQ ID NO: 5822 - DNA, 25 bp, Artificial Sequence
  Synthetic Oligonucleotide
ggaugucauucguaaagaugugcgt

SEQ ID NO: 5823 - DNA, 25 bp, Artificial Sequence
  Synthetic Oligonucleotide
ggaugucauucguaaagauguuagt

SEQ ID NO: 5824 - DNA, 25 bp, Artificial Sequence
  Synthetic Oligonucleotide
ggaugucauucguaaagauguuctt

SEQ ID NO: 5825 - DNA, 25 bp, Artificial Sequence
  Synthetic Oligonucleotide
ggaugucauucguaaagauguucga

SEQ ID NO: 5826 - RNA, 27 nt, Artificial Sequence
  Synthetic Oligonucleotide
ucgaacaucuuuacgaaugacauccuu

SEQ ID NO: 5827 - RNA, 27 nt, Artificial Sequence
  Synthetic Oligonucleotide
aagaacaucuuuacgaaugacauccuu

SEQ ID NO: 5828 - RNA, 27 nt, Artificial Sequence
  Synthetic Oligonucleotide
acuaacaucuuuacgaaugacauccuu

SEQ ID NO: 5829 - RNA, 27 nt, Artificial Sequence
  Synthetic Oligonucleotide
acgcacaucuuuacgaaugacauccuu

SEQ ID NO: 5830 - RNA, 27 nt, Artificial Sequence
  Synthetic Oligonucleotide
acgaucaucuuuacgaaugacauccuu

SEQ ID NO: 5831 - RNA, 27 nt, Artificial Sequence
  Synthetic Oligonucleotide
acgaaaaucuuuacgaaugacauccuu

SEQ ID NO: 5832 - RNA, 27 nt, Artificial Sequence
  Synthetic Oligonucleotide
acgaacuucuuuacgaaugacauccuu

SEQ ID NO: 5833 - DNA, 25 bp, Artificial Sequence
  Synthetic Oligonucleotide
acauugaaccauuucugauaaautc

SEQ ID NO: 5834 - DNA, 25 bp, Artificial Sequence
  Synthetic Oligonucleotide
acauugaaccauuucugaauaautc

SEQ ID NO: 5835 - DNA, 25 bp, Artificial Sequence
  Synthetic Oligonucleotide
acauugaaccauuucugaaauautc

SEQ ID NO: 5836 - DNA, 25 bp, Artificial Sequence
  Synthetic Oligonucleotide
acauugaaccauuucugaaaagutc

SEQ ID NO: 5837 - DNA, 25 bp, Artificial Sequence
  Synthetic Oligonucleotide
acauugaaccauuucugaaaaaatc

SEQ ID NO: 5838 - DNA, 25 bp, Artificial Sequence
  Synthetic Oligonucleotide
acauugaaccauuucugaaaaaugc

SEQ ID NO: 5839 - DNA, 25 bp, Artificial Sequence
  Synthetic Oligonucleotide
acauugaaccauuucugaaaaauta

SEQ ID NO: 5840 - RNA, 27 nt, Artificial Sequence
  Synthetic Oligonucleotide
uaauuuuucagaaaugguucaauguca

SEQ ID NO: 5841 - RNA, 27 nt, Artificial Sequence
  Synthetic Oligonucleotide
gcauuuuucagaaaugguucaauguca

SEQ ID NO: 5842 - RNA, 27 nt, Artificial Sequence
  Synthetic Oligonucleotide
gauuuuuucagaaaugguucaauguca

SEQ ID NO: 5843 - RNA, 27 nt, Artificial Sequence
  Synthetic Oligonucleotide
gaacuuuucagaaaugguucaauguca

SEQ ID NO: 5844 - RNA, 27 nt, Artificial Sequence
  Synthetic Oligonucleotide
gaauauuucagaaaugguucaauguca

SEQ ID NO: 5845 - RNA, 27 nt, Artificial Sequence
  Synthetic Oligonucleotide
gaauuauucagaaaugguucaauguca

SEQ ID NO: 5846 - RNA, 27 nt, Artificial Sequence
  Synthetic Oligonucleotide
gaauuuaucagaaaugguucaauguca

SEQ ID NO: 5847 - DNA, 25 bp, Artificial Sequence
  Synthetic Oligonucleotide
  misc_feature (22)..(25): n is a, c, g, t or u
uuaagugaauuugguuccaaannnn

SEQ ID NO: 5848 - RNA, 27 nt, Artificial Sequence
  Synthetic Oligonucleotide
  misc_feature (1)..(6): n is a, c, g, or u
nnnnnnuggaaccaaauucacuuaagg

SEQ ID NO: 5849 - DNA, 27 bp, Artificial Sequence
  Synthetic Oligonucleotide
  misc_feature (22)..(27): n is a, c, g, or t
ccttaagtgaatttggttccannnnnn

SEQ ID NO: 5850 - DNA, 33 bp, Artificial Sequence
  Synthetic Oligonucleotide
aaagccttaagtgaatttggttccaaaatcatc

We claim:

1. An isolated nucleic acid comprising an oligonucleotide strand of 19-50 nucleotides in length, wherein said oligonucleotide strand is complementary to SEQ ID NO: 2355 (5'-CCCAACAAGAACUAGAAGCUA-3') along at least 19 nucleotides of said oligonucleotide strand length and reduces CKAP5 target mRNA expression when said nucleic acid is introduced into a mammalian cell.

2. An isolated dsNA comprising first and second nucleic acid strands, wherein said first strand is 15-35 nucleotides in length and said second strand of said dsNA is 19-50 nucleotides in length, wherein said second nucleic acid strand is complementary to SEQ ID NO: 2355 (5'-CCCAACAAGAACUAGAAGCUA-3') along at least 19 consecutive nucleotides of said second strand length and said dsNA reduces CKAP5 target mRNA expression when said double stranded nucleic acid is introduced into a mammalian cell.

3. The isolated dsNA of claim 2 comprising a duplex region selected from the group consisting of at least 25 base pairs; 19-21 base pairs and 21-25 base pairs.

4. The isolated dsNA of claim 2, wherein said second nucleic acid strand comprises 1-5 single-stranded nucleotides at its 3' terminus.

5. The isolated dsNA of claim 2, wherein said first strand is 25-35 nucleotides in length.

6. The isolated dsNA of claim 2, wherein said second strand is 25-35 nucleotides in length.

7. The isolated dsNA of claim 2, wherein starting from the first nucleotide (position 1) at the 3' terminus of the first strand, position 1, 2 and/or 3 is substituted with a modified nucleotide.

8. The isolated dsNA of claim 2, wherein said 3' terminus of said first strand and said 5' terminus of said second strand form a blunt end.

9. The isolated dsNA of claim 2, wherein said first strand is 25 nucleotides in length and said second strand is 27 nucleotides in length.

10. The isolated dsNA of claim 2, wherein said second strand of said dsNA comprises the complement of SEQ ID NO: 2355 (5'-CCCAACAAGAACUAGAAGCUA-3').

11. The isolated dsNA of claim 2, wherein said second strand comprises SEQ ID NO: 627 (5'-CCAAUUUAGCUUCUAGUUCUUGUUGGG-3').

12. The isolated dsNA of claim 2, wherein said first strand comprises SEQ ID NO: 51 (5'-CAACAAGAACUAGAAGCUAAAUUgg-3').

13. The isolated dsNA of claim 2 comprising SEQ ID NO: 627 (5'-CCAAUUUAGCUUCUAGUUCUUGUUGGG-3') and SEQ ID NO: 51 (5'-CAACAAGAACUAGAAGCUAAAUUgg-3').

14. The isolated dsNA of claim 7, wherein said modified nucleotide residue of said 3' terminus of said first strand is selected from the group consisting of a deoxyribonucleotide, an acyclonucleotide and a fluorescent molecule.

15. The isolated dsNA of claim 14, wherein position 1 of said 3' terminus of the first strand is a deoxyribonucleotide.

16. The isolated dsNA of claim 2, wherein said nucleotides of said 1-5 single-stranded nucleotides of said 3' terminus of said second strand comprise a modified nucleotide.

17. The isolated dsNA of claim 16, wherein said modified nucleotide of said 1-5 single-stranded nucleotides of said 3' terminus of said second strand is a 2'-O-methyl ribonucleotide.

18. The isolated dsNA of claim 16, wherein all nucleotides of said 1-5 single-stranded nucleotides of said 3' terminus of said second strand are modified nucleotides.

19. The isolated dsNA of claim 2, wherein said dsNA comprises a modified nucleotide.

20. The isolated dsNA of claim 19, wherein said modified nucleotide residue is selected from the group consisting of 2'-O-methyl, 2'-methoxyethoxy, 2'-fluoro, 2'-allyl, 2'-O-[2-(methylamino)-2-oxoethyl], 4'-thio, 4'-CH2-O-2'-bridge, 4'-(CH2)2-O-2'-bridge, 2'-LNA, 2'-amino and 2'-O—(N-methylcarbamate).

21. The isolated dsNA of claim 2, wherein said 1-5 single-stranded nucleotides of said 3' terminus of said second strand are 1-3 nucleotides in length or are 1-2 nucleotides in length.

22. The isolated dsNA of claim 2, wherein said 1-5 single-stranded nucleotides of said 3' terminus of said second strand is two nucleotides in length and comprises a 2'-O-methyl modified ribonucleotide.

23. The isolated dsNA of claim 2, wherein said second strand comprises a modification pattern selected from the group consisting of AS-M1 to AS-M52 and AS-M1* to AS-M52*.

24. The isolated dsNA of claim 2, wherein said first strand comprises a modification pattern selected from the group consisting of SM1 to SM31.

25. The isolated dsNA of claim 2, wherein said dsNA is cleaved endogenously in said cell by Dicer.

26. The isolated nucleic acid of claim 1, wherein the amount of said isolated nucleic acid sufficient to reduce expression of the target gene is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

27. The isolated dsNA of claim 2, wherein said first strand comprises SEQ ID NO: 2355 (5'-CCCAACAAGAACUA-GAAGCUA 3').

28. The isolated dsNA of claim 2, wherein said isolated dsNA is complementary to the target CKAP5 mRNA sequence to reduce CKAP5 target mRNA expression by an amount (expressed by %) selected from the group consisting of at least 10%, at least 50%, at least 80-90%, at least 95%, at least 98%, and at least 99% when said double stranded nucleic acid is introduced into a mammalian cell.

29. The isolated dsNA of claim 2, wherein the first and second strands are joined by a chemical linker.

30. The isolated double stranded nucleic acid of claim 2, wherein said 3' terminus of said first strand and said 5' terminus of said second strand are joined by a chemical linker.

31. The isolated double stranded nucleic acid of claim 2, wherein a nucleotide of said second or first strand is substituted with a modified nucleotide that directs the orientation of Dicer cleavage.

32. The isolated nucleic acid of claim 2 comprising a modification selected from the group consisting of:
   a modified nucleotide selected from the group consisting of a deoxyribonucleotide, a dideoxyribonucleotide, an acyclonucleotide, a 3'-deoxyadenosine (cordycepin), a 3'-azido-3'-deoxythymidine (AZT), a 2',3'-dideoxyinosine (ddI), a 2',3'-dideoxy-3'-thiacytidine (3TC), a 2',3'-didehydro-2',3'-dideoxythymidine (d4T), a monophosphate nucleotide of 3'-azido-3'-deoxythymidine (AZT), a 2',3'-dideoxy-3'-thiacytidine (3TC) and a monophosphate nucleotide of 2',3'-didehydro-2',3'-dideoxythymidine (d4T), a 4-thiouracil, a 5-bromouracil, a 5-iodouracil, a 5-(3-aminoallyl)-uracil, a 2'-O-alkyl ribonucleotide, a 2'-O-methyl ribonucleotide, a 2'-amino ribonucleotide, a 2'-fluoro ribonucleotide, and a locked nucleic acid;
   a phosphate backbone modification selected from the group consisting of a phosphonate, a phosphorothioate and a phosphotriester;
   a morpholino nucleic acid; and
   a peptide nucleic acid (PNA).

33. A method for reducing expression of a target CKAP5 gene in a mammalian cell comprising contacting a mammalian cell in vitro with an isolated dsNA of claim 2 in an amount sufficient to reduce expression of the target CKAP5 mRNA in said cell.

34. The method of claim 33, wherein target CKAP5 mRNA expression is reduced by an amount (expressed by %) selected from the group consisting of at least 10%, at least 50% and at least 80-90%.

35. The method of claim 33, wherein CKAP5 mRNA levels are reduced by an amount (expressed by %) of at least 90% at least 8 days after said cell is contacted with said dsNA.

36. The method of claim 33, wherein CKAP5 mRNA levels are reduced by an amount (expressed by %) of at least 70% at least 10 days after said cell is contacted with said dsNA.

37. A method for reducing expression of a target CKAP5 mRNA in a mammal comprising administering an isolated nucleic acid of claim 1 to a mammal in an amount sufficient to reduce expression of a target CKAP5 mRNA in the mammal.

38. The method of claim 37, wherein said isolated nucleic acid is administered at a dosage selected from the group consisting of 1 microgram to 5 milligrams per kilogram of said mammal per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

39. The method of claim 37, wherein CKAP5 mRNA levels are reduced in a tissue of said mammal by an amount (expressed by %) of at least 70% at least 3 days after said isolated dsNA is administered to said mammal.

40. The method of claim 39, wherein said tissue is selected from the group consisting of liver, pancreatic and ovarian tissues.

41. The method of claim 37, wherein said administering step comprises a mode selected from the group consisting of intravenous injection, intramuscular injection, intraperitoneal injection, infusion, subcutaneous injection, transdermal, aerosol, rectal, vaginal, topical, oral and inhaled delivery.

42. A method for selectively inhibiting the growth of a cell comprising contacting a cell with an amount of an isolated nucleic acid of claim 1 sufficient to inhibit the growth of the cell.

43. The method of claim 42, wherein said cell is a tumor cell of a subject.

44. The method of claim 42, wherein said cell is a tumor cell in vitro.

45. The method of claim 42, wherein said cell is a human cell.

46. A formulation comprising the isolated nucleic acid of claim 1, wherein said nucleic acid is present in an amount effective to reduce target CKAP5 mRNA levels when said nucleic acid is introduced into a mammalian cell in vitro by an amount (expressed by %) selected from the group consisting of at least 10%, at least 50% and at least 80-90%.

47. The formulation of claim 46, wherein said effective amount is selected from the group consisting of 1 nanomolar or less, 200 picomolar or less, 100 picomolar or less, 50 picomolar or less, 20 picomolar or less, 10 picomolar or less, 5 picomolar or less, 2, picomolar or less and 1 picomolar or less in the environment of said cell.

48. A formulation comprising the isolated dsNA of claim 2, wherein said dsNA is present in an amount effective to reduce target CKAP5 mRNA levels when said dsNA is introduced into a cell of a mammalian subject by an amount (expressed by %) selected from the group consisting of at least 10%, at least 50% and at least 80-90%.

49. The formulation of claim 48, wherein said effective amount is a dosage selected from the group consisting of 1 microgram to 5 milligrams per kilogram of said subject per day, 100 micrograms to 0.5 milligrams per kilogram, 0.001 to 0.25 milligrams per kilogram, 0.01 to 20 micrograms per kilogram, 0.01 to 10 micrograms per kilogram, 0.10 to 5 micrograms per kilogram, and 0.1 to 2.5 micrograms per kilogram.

50. A mammalian cell containing the isolated nucleic acid of claim 1.

51. A pharmaceutical composition comprising the isolated nucleic acid of claim 1 and a pharmaceutically acceptable carrier.

52. A kit comprising the isolated nucleic acid of claim 1 and instructions for its use.

53. A method for treating an CKAP5-associated disease or disorder in a subject comprising administering the isolated nucleic acid of claim 1 and a pharmaceutically acceptable carrier to the subject in an amount sufficient to treat said CKAP5-associated disease or disorder in said subject, thereby treating of said CKAP5-associated disease or disorder in said subject.

54. The method of claim 53, wherein said CKAP5-associated disease or disorder is selected from the group consisting of renal, breast, lung, ovarian, liver, cervical, esophageal, oropharyngeal and pancreatic cancer.

55. A composition possessing CKAP5 inhibitory activity consisting essentially of an isolated nucleic acid of claim 1.

* * * * *